US012790634B1

(12) United States Patent
Carey-Medlock et al.

(10) Patent No.: US 12,790,634 B1
(45) Date of Patent: Nov. 10, 2026

(54) MOST PROBABLE NUMBER ANALYSIS OF HETEROGENOUS POPULATIONS

(71) Applicant: Vedanta Biosciences, Inc., Cambridge, MA (US)

(72) Inventors: Gregory Leonard Carey-Medlock, Cambridge, MA (US); Jeremiah James Faith, New York, NY (US); Tao Xu, Natick, MA (US); Matthew Songmin Schinn, Cambridge, MA (US); Cintia Felix, Nashua, NH (US)

(73) Assignee: Vedanta Biosciences, Inc., Cambridge, MA (US)

( * ) Notice: Subject to any disclaimer, the term of this patent is extended or adjusted under 35 U.S.C. 154(b) by 0 days.

(21) Appl. No.: 19/402,576

(22) Filed: Nov. 26, 2025

(51) Int. Cl.
*C12Q 1/06* (2006.01)

(52) U.S. Cl.
CPC .................................... *C12Q 1/06* (2013.01)

(58) Field of Classification Search
None
See application file for complete search history.

(56) References Cited

U.S. PATENT DOCUMENTS

| | | | |
|---|---|---|---|
| 2022/0064693 | A1 | 3/2022 | Justice et al. |
| 2024/0142363 | A1 | 5/2024 | Taguchi et al. |

FOREIGN PATENT DOCUMENTS

| | | | |
|---|---|---|---|
| WO | WO 2017/218680 | A1 | 12/2017 |
| WO | WO 2020/037271 | A1 | 2/2020 |
| WO | WO 2021/089504 | A1 | 5/2021 |
| WO | WO 2022/159711 | A1 | 7/2022 |
| WO | WO 2024/211569 | A1 | 10/2024 |
| WO | WO 2024/227021 | A2 | 10/2024 |
| WO | WO 2025/076184 | A1 | 4/2025 |

OTHER PUBLICATIONS

Soumare, Abdoulaye, et al. "From isolation of phosphate solubilizing microbes to their formulation and use as biofertilizers: status and needs." Frontiers in bioengineering and biotechnology 7 (2020): 425. (Year: 2020).*

So, Jae-Seong, et al. "Simultaneous detection of gfp-marked *Moraxella* sp. G21r and lux-marked Ralstonia eutrophas H850Lr using most-probable-number method." Journal of microbiological methods 43.2 (2000): 67-72. (Year: 2000).*

Franco Meléndez, Karla, et al. "MicroMPN: methods and software for high-throughput screening of microbe suppression in mixed populations." Microbiology Spectrum 12.3 (2024): e03578-23. (Year: 2024).*

Cooper, David M., et al. "A comparison of the MPN and pour plate methods for estimating shellfish contamination by *Escherichia coli*." Journal of Applied Microbiology 135.7 (2024): Ixae163. (Year: 2024).*

Ahmad et al., Most probable number-loop mediated isothermal amplification (MPN-LAMP) for quantifying waterborne pathogens in <25min. J Microbiol Methods. Jan. 2017;132:27-33. doi: 10.1016/j.mimet.2016.11.010. Epub Nov. 14, 2016.

Ben-David et al., Estimation method for serial dilution experiments. J Microbiol Methods. Dec. 2014;107:214-21. doi: 10.1016/j.mimet.2014.08.023. Epub Sep. 7, 2014.

Bibiloni et al., Enzyme-based most probable No. method for the enumeration of Bifidobacterium in dairy products. J Food Prot. Dec. 2001;64(12):2001-6. doi: 10.4315/0362-028x-64.12.2001.

Blodgett et al., Several MPN models for serial dilutions with suppressed growth at low dilutions. Food Microbiol. Feb. 1998;15(1):91-9. doi: 10.1006/fmic.1997.0144.

Blodgett, Planning a serial dilution test with multiple dilutions. Food Microbiol. Jun. 2009;26(4):421-4. doi: 10.1016/j.fm.2009.02.001. Epub Feb. 25, 2009.

Böllmann et al., Comparison of different media for the detection of denitrifying and nitrate reducing bacteria in mesotrophic aquatic environments by the most probable number method. J Microbiol Methods. Jan. 2020;168:105808. doi: 10.1016/j.mimet.2019.105808. Epub Dec. 12, 2019.

Cascales et al., Colicin biology. Microbiol Mol Biol Rev. Mar. 2007;71(1):158-229. doi: 10.1128/MMBR.00036-06.

Chen et al., A 6×6 drop plate method for simultaneous colony counting and MPN enumeration of Campylobacter jejuni, Listeria monocytogenes, and *Escherichia coli*. J Microbiol Methods. Nov. 2003;55(2):475-9. doi: 10.1016/s0167-7012(03)00194-5.

Chen et al., Comparative evaluation of direct plating and most probable number for enumeration of low levels of Listeria monocytogenes in naturally contaminated ice cream products. Int J Food Microbiol. Jan. 16, 2017;241:15-22. doi: 10.1016/j.ijfoodmicro.2016.09.021. Epub Sep. 26, 2016.

De Man, MPN Tables, Corrected. Eur J Appl Microbiol Biotechnol. 1983;17:301-5.

Derrien et al., *Akkermansia muciniphila* gen. nov., sp. nov., a human intestinal mucin-degrading bacterium. Int J Syst Evol Microbiol. Sep. 2004;54(Pt 5):1469-1476. doi: 10.1099/ijs.0.02873-0.

Evans et al., Failure of the most-probable-number technique to detect coliforms in drinking water and raw water supplies. Appl Environ Microbiol. Jan. 1981;41(1):130-8. doi: 10.1128/aem.41.1.130-138.1981.

Franco Meléndez et al., MicroMPN: methods and software for high-throughput screening of microbe suppression in mixed populations. Microbiol Spectr. Mar. 5, 2024;12(3):e0357823. doi: 10.1128/spectrum.03578-23. Epub Feb. 14, 2024.

(Continued)

*Primary Examiner* — Larry D Riggs, II
*Assistant Examiner* — Kettip Kriangchaivech
(74) *Attorney, Agent, or Firm* — Wolf, Greenfield & Sacks, P.C.

(57) ABSTRACT

Provided are methods for determining the abundance of distinct members of a population in a heterogenous population using most probable number (MPN) analysis by correcting for the between-member interactions at limiting dilutions. Also provided are methods for manufacturing compositions containing a heterogenous population containing population members at narrower manufacturing tolerances than those manufactured without correcting for between-member interactions.

25 Claims, 3 Drawing Sheets

Specification includes a Sequence Listing.

(56) References Cited

OTHER PUBLICATIONS

Garthwright et al., FDA's preferred MPN methods for standard, large or unusual tests, with a spreadsheet. Food Microbiol. Aug. 2003;20(4):439-445. doi: 10.1016/S0740-0020(02)00144-2.
Garzarelli et al., Ultrasensitive qPCR platform for rapid detection of bacterial contamination of raw biological samples at the point of care. Heliyon. May 13, 2023;9(5):e16229. doi: 10.1016/j.heliyon.2023.e16229.
Gronewold et al., Modeling the relationship between most probable number (MPN) and colony-forming unit (CFU) estimates of fecal coliform concentration. Water Res. Jul. 2008;42(13):3327-34. doi: 10.1016/j.watres.2008.04.011. Epub Apr. 16, 2008.
Hindson et al.,High-throughput droplet digital PCR system for absolute quantitation of DNA copy number. Anal Chem. Nov. 15, 2011;83(22):8604-10. doi: 10.1021/ac202028g. Epub Oct. 28, 2011.
Honda et al., Rationally-defined microbial consortia suppress multidrug-resistant proinflammatory Enterobacteriaceae via ecological control. Res Sq [Preprint]. Oct. 23, 2023:rs.3.rs-3462622. doi: 10.21203/rs.3.rs-3462622/v1. Update in: Nature. Sep. 2024;633(8031):878-886. doi: 10.1038/s41586-024-07960-6.
Irwin et al., A Modified Gauss-Newton Algorithm and Ninety-Six Well Micro-Technique For Calculating MPN Using Excel Spreadsheets. J Rapid Methods Automat Microbiol. 2000;8:171-91.
Jarvis et al., Reconsideration of the derivation of Most Probable Numbers, their standard deviations, confidence bounds and rarity values. J Appl Microbiol. Nov. 2010;109(5):1660-7. doi: 10.1111/j.1365-2672.2010.04792.x. Epub Jul. 2, 2010. Erratum in: J Appl Microbiol. Sep. 2015;119(3):905. doi: 10.1111/jam.12901. 9 pages.
Kim et al., Droplet digital PCR method for the absolute quantitative detection and monitoring of Lacticaseibacillus casei. Food Microbiol. Aug. 2023;113:104265. doi: 10.1016/j.fm.2023.104265. Epub Mar. 10, 2023.
Konstantinidis et al., Genomic insights that advance the species definition for prokaryotes. Proc Natl Acad Sci U S A. Feb. 15, 2005;102(7):2567-72. doi: 10.1073/pnas.0409727102. Epub Feb. 8, 2005.
Martini et al., Maximum likelihood estimators for colony-forming units. Microbiol Spectr. Sep. 3, 2024;12(9):e0394623. doi: 10.1128/spectrum.03946-23. Epub Jul. 23, 2024.
Martins et al., Simultaneous enumeration of yeast and bacterial cells in the context of industrial bioprocesses. J Ind Microbiol Biotechnol. Jan. 9, 2024;51:kuae029. doi: 10.1093/jimb/kuae029.
Mcbride et al., Uncertainty in most probable number calculations for microbiological assays. J AOAC Int. Sep.-Oct. 2003;86(5):1084-8.
Needleman et al., A general method applicable to the search for similarities in the amino acid sequence of two proteins. J Mol Biol. Mar. 1970;48(3):443-53. doi: 10.1016/0022-2836(70)90057-4.
Parks et al., A complete domain-to-species taxonomy for Bacteria and Archaea. Nat Biotechnol. Sep. 2020;38(9):1079-1086. doi: 10.1038/s41587-020-0501-8. Epub Apr. 27, 2020. Erratum in: Nat Biotechnol. Sep. 2020;38(9):1098. doi: 10.1038/s41587-020-0539-7.
Parks et al., A standardized bacterial taxonomy based on genome phylogeny substantially revises the tree of life. Nat Biotechnol. Nov. 2018;36(10):996-1004. doi: 10.1038/nbt.4229. Epub Aug. 27, 2018.
Quan et al., dPCR: A Technology Review. Sensors (Basel). Apr. 20, 2018;18(4):1271. doi: 10.3390/s18041271.
Schalk et al., Potency estimation of measles, mumps and rubella trivalent vaccines with quantitative PCR infectivity assay. Biologicals. Jun. 2005;33(2):71-9. doi: 10.1016/j.biologicals.2005.01.001. Epub Apr. 7, 2005.
Shaw et al., Fast and robust metagenomic sequence comparison through sparse chaining with skani. Nat Methods. Nov. 2023;20(11):1661-1665. doi: 10.1038/s41592-023-02018-3. Epub Sep. 21, 2023.
Thomas, Bacterial Densities From Fermentation Tube Tests. J Am Water Works Assoc. Apr. 1, 1942;34(4):572-6. doi: 10.1002/j.1551-8833.1942.tb19721.x.
Wang et al., Supercharged MPNs? Automated Determination of High-Throughput Most Porbable Number (htMPN) Using Chip-Baswed 3D Digital PCR. Appl Environment Microbiol. Aug. 2022;88(15). doi: 10.1128/aem.00822-22. 12 pages.

* cited by examiner

MOST PROBABLE NUMBER ANALYSIS OF HETEROGENOUS POPULATIONS

REFERENCE TO AN ELECTRONIC SEQUENCE LISTING

The contents of the electronic sequence listing (P074570044US00-SEQ-NTJ.xml; Size: 84,860,309 bytes and Date of Creation: Nov. 25, 2025) are herein incorporated by reference in their entirety.

BACKGROUND

The most probable number (MPN) technique measures the number of individuals in a population by preparing a series of dilutions from a sample, incubating those dilutions to yield a signal that an individual was initially present in the dilution, and determining the most probable number of individuals in the original sample based on patterns of presence or absence across the dilutions of the original sample. MPN analysis is typically performed to estimate the number of coliforms or other pathogenic bacteria in an environmental or food sample for applications such as assessing whether a water or food sample meets human-use or consumption standards. Incubations in an MPN measurement allow growth and replication of the organisms being detected, with absence of the organisms being inferred from lack of a signal, indicating lack of growth to a level that generates the observable signal.

SUMMARY

Provided herein are methods for determining the most probable number (MPN) of distinct members of a mixed population in a manner that accounts for antagonistic and/or synergistic interactions between population members during the incubation step of an MPN assay. A mixed population may include multiple distinct subpopulations, or population members. Where a mixed population is diluted for analysis in an MPN assay, different replicates in the incubation step may comprise multiple distinct population members. Where a first population member inhibits growth of a second, such that a signal of the second is not detected, that replicate would be identified as "negative" for the second population member, even though the second population member was actually present in the replicate, making it a false negative. Such false negatives cause underestimation of a population member's true abundance. Conversely, synergistic interactions between population members may increase the chance of detecting one or both partners, leading to overestimation of their abundance relative to analysis of a pure population of a single population member. Biases introduced by such interactions between population members are undesirable, inter alia, in manufacturing, formulating, and therapeutic use of compositions comprising a mixed population with defined abundance tolerances of population members. Compositions with underestimated abundance of a population member (and actual abundance above a desired maximum) may pose safety risks from administering higher doses than intended, for example, while those with overestimated abundance (and actual abundance below a desired minimum) may have reduced effectiveness. And, when compositions are stored for an extended period, biased estimation may cause compositions to be discarded prematurely, despite actually containing each population member within a desired abundance tolerance, or held and used despite actually containing each population member outside a desired abundance tolerance.

For a mixed population with unknown abundance of population members, bias in MPN determination may be corrected using a predetermined calibration matrix, which correlates (Y) known "reference standard" abundance values of population members in a calibration sample prepared from pure separate populations of known abundance (FIG. 1), with (X) uncorrected abundance of those population members in the calibration sample as measured by an MPN assay (FIG. 2). Using such a calibration matrix, the correlation observed in a calibration sample may be applied to MPN analysis of another mixed population containing the same population members at unknown abundance, transforming biased estimates to more reliable ones (FIG. 3). Without wishing to be bound by theory, the inventors posit that transformation with such a calibration matrix improves the accuracy of MPN-based methods of measuring abundance of population members in compositions comprising mixed populations, such as those intended for therapeutic use. This improved accuracy is useful, inter alia, for reducing the risks of reduced safety and effectiveness associated with underestimation and overestimation, respectively, and for reducing waste of compositions due to premature conclusions of lost potency, and for preventing use or release of compositions that have degraded beyond acceptable limits when potency is overestimated.

Accordingly, some aspects relate to a method of quantifying an abundance of a member in a composition comprising a mixed population of at least two members, the method comprising estimating unadjusted most probable number (MPN) abundances of the member and at least one other member in the mixed population using an MPN assay, and estimating an adjusted MPN abundance of the member by transforming the unadjusted MPN abundance of the member with a predetermined calibration matrix, wherein the MPN assay comprises: (i) preparing a plurality of serially diluted samples of the mixed population; (ii) incubating the plurality of serially diluted samples of the mixed population under conditions to allow replication, metabolism, or gene expression of the at least two members; (iii) identifying presence or absence of the at least two members of the mixed population in the plurality of serially diluted samples of the mixed population; and (iv) determining the unadjusted MPN abundances of the at least two members, wherein the predetermined calibration matrix correlates unadjusted MPN abundances to reference standard abundances of the at least two members in a calibration sample, and wherein the calibration sample comprises the at least two members in predetermined reference standard abundances.

In some embodiments, the predetermined calibration matrix comprises one or more element accounting for interactions between the at least two members of the mixed population in the incubating of (ii). In some embodiments, at least one element is derived from a regression model correlating a predetermined reference standard abundance of the member to unadjusted MPN abundances of the at least two members in the calibration sample. In some embodiments, unadjusted MPN abundance of each of the at least two members is calculated with assumption that identifying the presence or absence of a member in step (iii) is independent of the presence or absence of other members in the same serially diluted sample. In some embodiments, predetermined reference standard abundances of the at least two members are defined by abundances of the at least two members in separate samples each consisting essentially of a single member, and wherein the calibration sample comprises a combination of the separate samples in a predetermined proportion. In some embodiments, for the set of the at least two members of the calibration sample, mean deviation of adjusted MPN abundance from the predetermined reference standard abundance in the calibration sample is less than mean deviation of unadjusted MPN abundance from the predetermined reference standard abundance in the calibration sample.

In some embodiments, presence of a member is defined by detection of a signal of the member above a detectable threshold, and absence is defined by lack of detection of the signal above the detectable threshold.

In some embodiments, the method is a method of quality control of a composition, and the method comprises identifying the composition as comprising the at least two members within a defined abundance tolerance. In some embodiments, the method further comprises administering the composition to a subject in need thereof. In some embodiments, the method further comprises formulating or packaging the composition for administration to a subject in need thereof at a dose of the at least two members within the defined abundance tolerance.

Some aspects relate to a composition or plurality of compositions made by such a method.

In some embodiments, the mixed population is a bacterial population, and each of the at least two members is a distinct bacterial strain. In some embodiments, one or more of the bacterial strains are strict anaerobes, and wherein reagents used in measuring reference standard abundance and MPN abundance are pre-reduced in an anaerobic environment for a duration sufficient to eliminate negative influence of environmental components on bacterial growth, wherein the reagents comprise diluent and culture media.

Some aspects relate to a composition comprising a mixed population comprising at least two members at adjusted most probable number (MPN) abundance within a defined abundance tolerance, wherein adjusted MPN abundance of a member is estimated by (1) estimating unadjusted MPN abundance of the member and at least one other member in the mixed population using an MPN assay, and (2) transforming the unadjusted MPN abundance of the member with a predetermined calibration matrix, wherein the MPN assay comprises: (i) preparing a plurality of serially diluted samples of the mixed population; (ii) incubating the plurality of serially diluted samples of the mixed population under conditions to allow replication, metabolism, or gene expression of the at least two members; (iii) identifying presence or absence of the at least two members of the mixed population in the plurality of serially diluted samples of the mixed population; and (iv) determining the unadjusted MPN abundances of the at least two members, wherein the predetermined calibration matrix correlates unadjusted MPN abundances to reference standard abundances of the at least two members in a calibration sample, and wherein the calibration sample comprises the at least two members in predetermined reference standard abundances.

In some embodiments, the predetermined calibration matrix comprises one or more elements accounting for interactions between the at least two members of the mixed population in the incubating of (ii). In some embodiments, at least one element is derived from a regression model correlating a predetermined reference standard abundance of a member to unadjusted MPN abundances of the at least two members in the calibration sample. In some embodiments, unadjusted MPN abundance of each of the at least two members is calculated with assumption that identifying the presence or absence of a member in step (iii) is independent of the presence or absence of other members in the same serially diluted sample. In some embodiments, predetermined reference standard abundances of the at least two members are defined by abundances of the at least two members in separate samples each consisting essentially of a single member, and wherein the calibration sample comprises a combination of the separate samples in a predetermined proportion. In some embodiments, for the set of the at least two members of the calibration sample, mean deviation of adjusted MPN abundance from the predetermined reference standard abundance in the calibration sample is less than mean deviation of unadjusted MPN abundance from the predetermined reference standard abundance in the calibration sample.

In some embodiments, presence of a member is defined by detection of a signal of the member above a detectable threshold, and absence is defined by lack of detection of the signal above the detectable threshold.

In some embodiments, the composition is formulated or packaged for administration to a subject in need thereof at a dose of each of the at least two population members within the defined abundance tolerance. Some aspects relate to a plurality of such compositions.

In some embodiments, the mixed population is a bacterial population, and each of the at least two members is a distinct bacterial strain. In some embodiments, one or more of the bacterial strains are strict anaerobes, and wherein reagents used in measuring reference standard abundance and MPN abundance are pre-reduced in an anaerobic environment for a duration sufficient to eliminate negative influence of environmental components on bacterial growth, wherein the reagents comprise diluent and culture media.

DETAILED DESCRIPTION

Figure 1:
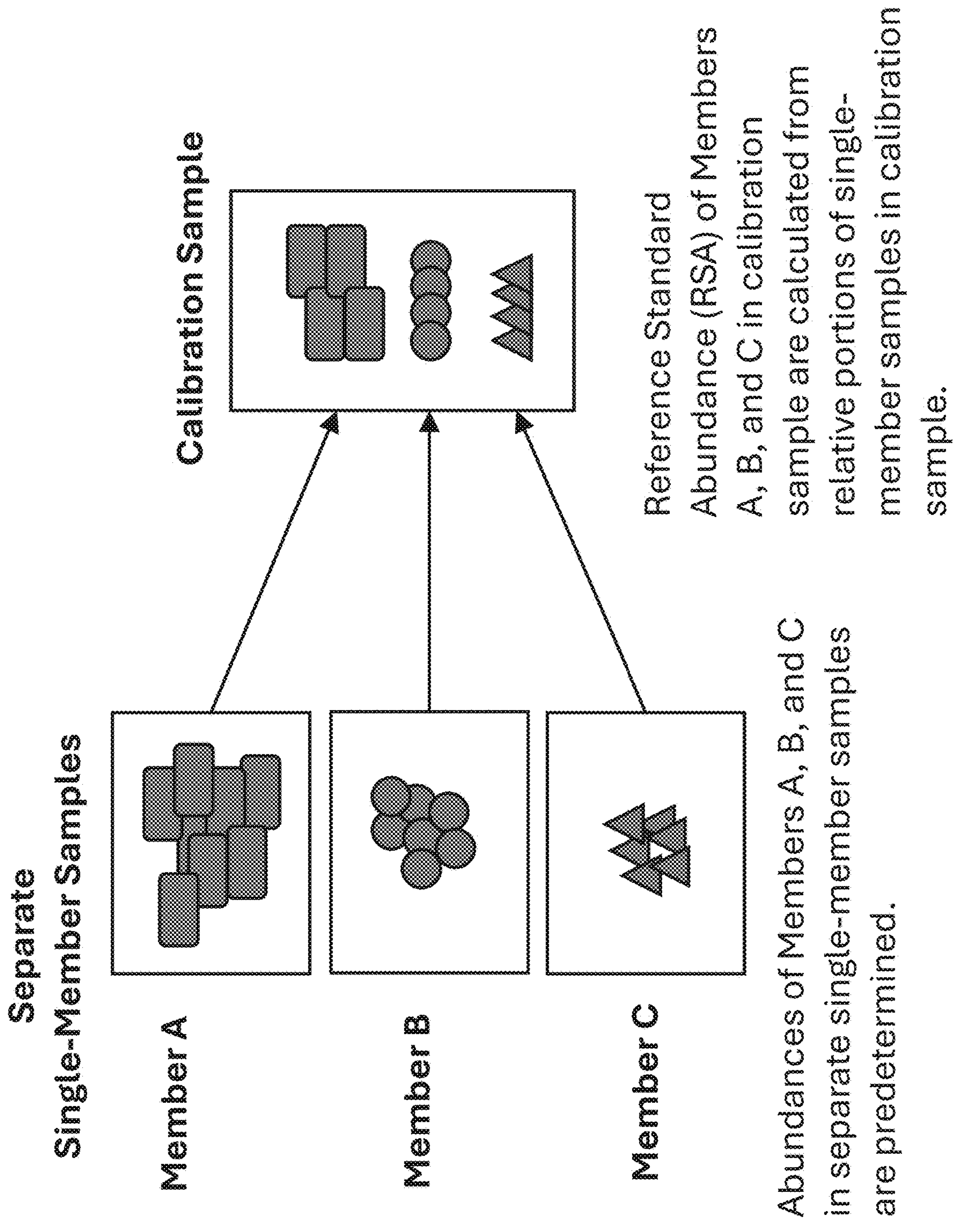
FIG. 1 shows preparation of a calibration sample with predetermined reference standard abundances based on measurements of separate single-member populations.

Some aspects relate to a method of estimating adjusted most probable number (MPN) abundances of at least two members i and j in a composition comprising a mixed population by estimating unadjusted MPN abundances of the at least two members i and j using an MPN assay, and transforming the unadjusted MPN abundances with a calibration matrix that correlates unadjusted MPN abundances of the at least two members i and j in a separate calibration sample to reference standard abundances of the members i and j in the calibration sample, to yield adjusted MPN abundances.

Such methods are useful, inter alia, for quality control of a composition, such as identifying the composition as comprising one or more population members within a defined abundance tolerance, determining whether the composition is suitable for administration to achieve a desired dose of one or more population members, or for formulating into a composition for administration within a defined abundance tolerance. Thus, in some embodiments, the method comprises identifying the composition as comprising at least two population members i and j within a defined abundance tolerance. In some embodiments, the method comprises identifying the composition as comprising at least two population members i and j within a defined abundance tolerance for a defined period of time. In some embodiments, the method comprises formulating or packaging the composition for administration to a subject in need thereof at a dose of at least two population members i and j within a defined abundance tolerance. Some embodiments relate to a composition prepared by such a method. Some embodiments relate to a plurality of such compositions.

Some aspects relate to a composition comprising a mixed population of at least two members i and j at adjusted most probable number (MPN) abundances within a defined abundance tolerance. Some aspects relate a plurality of such compositions.

A "mixed population," as used herein, refers to a set of two or more biological entities that are distinguishable from each other (e.g., organisms, strains, or clones), such that the mixed population may be subdivided into distinct subpopulations, each distinct subpopulation being referred to as a "population member." Within a population or subpopulation that consists of a given population member, individuals (e.g., discrete organisms or cells) may differ from each other while still being identifiable as that population member. For example, individuals may differ from each other by one or more genomic nucleotide substitutions, insertions, or deletions; presence or absence of an accessory genetic element (e.g., plasmid in bacteria); state of expression of one or more genes; and/or epigenetic modifications, while still exhibiting a common characteristic that distinguishes them from other population members j and allowing their identification as population member i.

In a population of N population members, distinct population members may be referred to by distinct numbers (e.g., population members 1, 2, 3, 4, 5, 6, 7, and 8 for a population comprising N=8 population members). For simplicity, an arbitrary population member may be referred to as "population member i" (e.g., a population member i may be any one of population members 1 to 8 when N=8). Reference to "each population member" will be understood as referring to each population member from i=1 to N (e.g., the set of population members 1, 2, 3, 4, 5, 6, 7, and 8 when N=8).

A population member i may be compared to other arbitrary population members by reference to another "population member j." Unless otherwise clear from context, reference to another population member j will be understood to encompass any one of j=1 to N where i≠j, and reference to "each population member j" or "each other population member" will be understood to encompass each of j=1 to N where i≠j.

Adjusted Most Probable Number (MPN) Abundance

Reference Standard Abundance Measurement and Calibration Samples

Some aspects contemplate correlation of unadjusted most probable number (MPN) abundances of at least two population members i and j in a calibration sample to reference standard abundances of the at least two population members i and j in the calibration sample. Some aspects contemplate a calibration matrix that correlates unadjusted MPN abundances of at least two population members i and j to reference standard abundances of the at least two population members i and j in a calibration sample.

"Abundance," as used herein, refers to the size of a population in terms of discrete individual units. As one example, the size of a bacterial population may be represented in terms of colony-forming units (CFUs). "Reference standard abundance" of a population member i, as used herein, refers to an abundance whose measurement is free from the influence of other population members j. Reference standard abundance of a population member i may be measured by measuring the size of a substantially pure population of the population member i. A substantially pure population of a population member i "consists essentially of" the population member i when it does not comprise any other population member j above a limit of detection. A substantially pure population "consists of" the population member i when the population member i is the only biological entity capable of replication that is present above a limit of detection. Reference standard abundance of a population member i in a mixed population, such as in a calibration sample, may also be measured using a method that eliminates the influence of other population members j on measurement (e.g., selective plating or a PCR-based method using primers specific for the population member i).

A "reference standard abundance method," as used herein, refers to a method that measures the size of a population in units representing discrete individuals of the population (e.g., colony-forming units, plaque-forming units, genome copy number, cell number). In some embodiments, a reference standard abundance method yields one or more discrete signal events, each representing a single individual of the population. The skilled artisan will appreciate that in certain methods (e.g., digital polymerase chain reaction (dPCR) or droplet digital PCR (ddPCR)), some proportion of discrete signal events is expected to represent two or more individuals, and so abundance may be estimated from the number of negative and positive discrete signal events using the Poisson distribution. Other methods capable of generating discrete signal events corresponding to individual organisms or cells, such as microscopy-based counting, flow cytometry, or single-cell sequencing, may also be used to determine reference standard abundance.

Suitable units of a reference standard abundance, and measurement of such units by a reference standard abundance method, will depend on the population, but are known to those skilled in the relevant biological art. Non-limiting examples of suitable units and corresponding methods of measurement for different types of entities include:

- For prokaryotes and archaea: colony-forming units (CFUs) and genome copy number;
- For viruses: plaque-forming units (PFUs), focus-forming units (FFUs), and genome or genome segment copy number;
- For eukaryotes: cell number, colony-forming units for eukaryotes that form colonies, and genome copy number;
- For animal cells, cell number.

Reference standard abundance of nucleic acid copy number may be measured by dPCR, ddPCR, or real-time quantitative PCR (qPCR) in combination with a standard curve. CFUs may be measured by dilution and plating. PFUs may be measured by a plaque assay. FFUs may be measured by a focus-forming assay. Cell number may be measured by flow cytometry (measuring proportional abundance) combined with an independent measure of total cell number (measuring total population size).

A "calibration sample," as used herein, refers to a composition comprising a mixed population that comprises at least two population members at defined reference standard abundances. A "calibration sample population" refers to the mixed population in a calibration sample. A mixed population comprising multiple population members at known reference standard abundances (e.g., a calibration sample population) or a composition comprising such a mixed population (e.g., a calibration sample) may be prepared by measuring the abundances of the population members in separate, substantially pure populations using a reference standard abundance method, and combining portions of the separate substantially pure populations in defined amounts. An example of this process is shown in FIG. 1.

In some embodiments, a calibration sample comprises at least two population members at substantially equal reference standard abundances. In some embodiments, a calibration sample comprises each population member i at substantially equal reference standard abundance. In some embodiments, each population member i is present at a reference standard abundance that is 10% to 1,000% of the reference standard abundance of each other population member j. In some embodiments, each population member i is present at a reference standard abundance that is 30% to 300% of the reference standard abundance of each other population member j. In some embodiments, each population member i is present at a reference standard abundance that is 50% to 200% of the reference standard abundance of each other population member j. In some embodiments, each population member i is present at a reference standard abundance that is 90% to 110% of the reference standard abundance of each other population member j.

Some embodiments contemplate a plurality of calibration samples. Without wishing to be bound by a particular theory, it is posited that use of multiple calibration samples improves the accuracy and/or precision of estimated correlations (e.g., regression coefficients) of reference standard abundance to unadjusted MPN abundance of population members. Additionally, different calibration samples may contain population members in different absolute abundances and/or ratios between population members i and j, allowing for observation of how these parameters may bias estimation of unadjusted MPN abundance.

In some embodiments, reference standard abundance of populations members is estimated in at least two calibration samples. In some embodiments, reference standard abundance of each population member i is estimated in each of a plurality of calibration samples.

In some embodiments, unadjusted MPN abundance of population members is estimated in at least two calibration samples. In some embodiments, unadjusted MPN abundance of each population member i is estimated in each of a plurality of calibration samples. In some embodiments, reference standard abundances are correlated to unadjusted MPN abundances in at least two calibration samples. In some embodiments, regression coefficients are estimates of a regression model correlating a plurality of reference standard abundances of a population member i, k to a plurality of unadjusted MPN abundances of the population member i, k in the plurality of calibration samples.

In some embodiments, the plurality of calibration samples comprises at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 calibration samples.

In some embodiments, the reference standard abundances of at least two population members in each calibration sample k are substantially equal to the reference standard abundances of the at least two population members in each other calibration sample. In some embodiments, the reference standard abundance of each population member i in each calibration sample k is substantially equal to the reference standard abundance of the population member i in each other calibration sample.

In some embodiments, the reference standard abundance of at least two population members i and j in each calibration sample k is 10% to 1,000% of the reference standard abundance of the population members i and j in each other calibration sample. In some embodiments, the reference standard abundance of at least two population members i and j in each calibration sample k is 30% to 300% of the reference standard abundance of the population members i and j in each other calibration sample. In some embodiments, the reference standard abundance of at least two population members i and j in each calibration sample k is 50% to 200% of the reference standard abundance of the population members i and j in each other calibration sample. In some embodiments, the reference standard abundance of at least two population members i and j in each calibration sample k is 90% to 110% of the reference standard abundance of the population members i and j in each other calibration sample.

In some embodiments, the reference standard abundance of each population member i in each calibration sample k is 10% to 1,000% of the reference standard abundance of the population member i in each other calibration sample. In some embodiments, the reference standard abundance of each population member i in each calibration sample k is 30% to 300% of the reference standard abundance of the population member i in each other calibration sample. In some embodiments, the reference standard abundance of each population member i in each calibration sample k is 50% to 200% of the reference standard abundance of the population member i in each other calibration sample. In some embodiments, the reference standard abundance of each population member i in each calibration sample k is 90% to 110% of the reference standard abundance of the population member i in each other calibration sample.

In some embodiments, two or more of the calibration samples are prepared independently. Two samples are prepared "independently" if they are not prepared by the same actor, in the same facility, on the same day, using the same substantially pure single-member populations and lots of reagents. In some embodiments, two or more of the calibration samples are prepared by different actors. In some embodiments, two or more of the calibration samples are prepared on different days. In some embodiments, two or more of the calibration samples are prepared in different facilities. In some embodiments, two or more of the calibration samples are prepared using different single-member populations. In some embodiments, two or more of the calibration samples are prepared using different lots of one or more reagents. In some embodiments, each calibration sample k is prepared independently.

In some embodiments, two MPN assays of different calibration samples are performed independently. Two MPN assays are performed "independently" if they are not performed by the same actor, in the same facility, on the same day, using the same lots of reagents. In some embodiments, the MPN assays of two or more of the calibration samples are performed by different actors. In some embodiments, the MPN assays of two or more of the calibration samples are performed on different days. In some embodiments, the MPN assays of two or more of the calibration samples are performed in different facilities. In some embodiments, the MPN assays of two or more of the calibration samples are performed using different lots of one or more reagents. In some embodiments, the MPN assay of each of the calibration samples is performed independently.

In some embodiments, a single calibration matrix is derived using pooled data from each calibration sample k. In some embodiments, derivation of a calibration matrix from data obtained from multiple calibration samples models the effect of a given calibration sample k as a random effect.

In some embodiments, for at least one population member, reference standard abundance is measured with a standard error of the mean that is no more than 25%, no more than 20%, no more than 15%, no more than 10%, or no more than 5% of the estimated reference standard abundance. In some embodiments, standard error of the mean is no more than 25%, no more than 20%, no more than 15%, no more than 10%, or no more than 5% of the estimated reference standard abundance for at least two population members i and j. In some embodiments, standard error of the mean is no more than 25%, no more than 20%, no more than 15%, no more than 10%, or no more than 5% of the estimated reference standard abundance for a majority of population members. In some embodiments, standard error of the mean is no more than 25%, no more than 20%, no more than 15%, no more than 10%, or no more than 5% of the estimated reference standard abundance for each population member.

In some embodiments, for at least one population member, the lower and upper bounds of a 95% confidence interval of reference standard abundance are, respectively: (1) no less than 75% and no more than 125% of the estimated reference standard abundance; (2) no less than 80% and no more than 120% of the estimated reference standard abundance; (3) no less than 85% and no more than 115% of the estimated reference standard abundance; (4) no less than 90% and no more than 110% of the estimated reference standard abundance; or (5) no more than 95% and no more than 105% of the estimated reference standard abundance. In some embodiments, the specified upper and lower bounds of confidence intervals apply to at least two population members i and j. In some embodiments, the specified upper and lower bounds of confidence intervals apply to a majority of population members. In some embodiments, the specified upper and lower bounds of confidence intervals apply to each population member.

Calculation of summary statistics, including standard deviation and confidence intervals, and selection of sample size suitable for achieving a given standard error of the mean, are within the level of ordinary skill in the art.

MPN Assay and Unadjusted MPN Abundance Measurement

Some aspects contemplate measuring of abundance of at least two population members i and j in a mixed population and in one or more calibration samples using a most probable number (MPN) assay. Some aspects contemplate unadjusted (uncorrected) measures of most probable number (MPN) abundance of at least two members i and j in a mixed population and in one or more calibration samples.

A "most probable number (MPN) assay," as used herein, refers to a method of measuring the most probable number of individuals in a population by (i) preparing a series of dilutions from the population; (ii) incubating samples of the dilution series in independent replicates under conditions that allow biological activity (e.g., metabolism, gene expression, replication) by members of the population; (iii) identifying the independent replicates as containing individuals of the population (presence) or lacking individuals of the population (absence), based on a signal of presence or absence; and (iv) determining the most probable number of individuals in the population using the presence and absence information obtained in step (iii). The most probable number of individuals in the population may be estimated using the relative concentrations of the population in the dilution series, the number of replicates at each dilution in which presence and absence are identified, and assumed initial numbers of individuals represented by presence (minimum initial number (e.g., 1)) and absence (maximum initial number (e.g., 0)).

In some embodiments, the MPN assay comprises: (i) preparing a plurality of serially diluted samples of the mixed population; (ii) incubating the plurality of serially diluted samples of the mixed population under conditions to allow replication, metabolism, or gene expression of the at least two members; (iii) identifying presence or absence of the at least two members of the mixed population in the plurality of serially diluted samples of the mixed population; and (iv) determining the unadjusted MPN abundances of the at least two members.

Regarding step (i), skilled artisan will appreciate that serial dilution yields a range of dilutions, the range being bounded by a minimum dilution at the lower end and a maximum dilution at the upper end. Dilutions in a series may be separated from each other by a dilution factor that is consistent between dilutions (e.g., a factor of 10, in a series of 10-fold, 100-fold, 1,000-fold, and 10,000-fold dilutions), or dilution factors may vary between successive dilutions.

Regarding step (ii), an MPN assay may include incubation of multiple independent replicates at a given dilution. The skilled artisan will appreciate that near limiting dilutions for a population member, independent replicates of samples at the same dilution may differ in whether the population member is detected, as stochasticity causes some replicates to contain the population member and others to lack the population member at those dilutions.

Regarding step (iii), presence or absence of a population member may be defined by detection (presence) or lack of detection (absence) of a signal attributable to the population member above a detectable threshold. A "signal" of presence of a population member, as used herein, is an observable phenomenon that is caused by and identifies the population member, observance of which allows the skilled artisan to conclude that the population member was present in a replicate of an MPN assay at the start of incubation. As one example, where a population member i comprises a nucleic acid with a nucleotide sequence that is not present in any other population member j, the presence of nucleic acids comprising that nucleotide sequence above a detectable threshold at the conclusion of an incubation is one signal that the population member i was present at the start of the incubation. As another example, detection of a metabolite that is produced by the population member i but not any other population member j is another signal of presence of the population member i.

In some embodiments, incubation is optional. For example, when the detectable signal of presence or absence of a population member arises from an enzymatic, biochemical, or other immediate reaction, incubation to permit growth or replication is not required. In some embodiments, the assay detects individuals capable of generating or contributing to the measurable signal, rather than individuals capable of growth or replication. Accordingly, incubation may be omitted, or performed only for a minimal period sufficient to allow completion of the signal-generating biochemical reaction.

Suitable signals of presence of population members, and methods of measuring such signals, will depend on the population, but are known to those skilled in the relevant biological art. Non-limiting examples of suitable signals and corresponding methods of measurement for different types of entities include: production of one or more metabolites; consumption of one or more metabolites; presence of one or more distinguishing nucleic acids; distinguishing morphology; and presence of one or more distinguishing surface proteins or epitopes thereof.

Production or consumption of metabolites may be measured by spectroscopy. Presence of nucleic acids may be measured by a PCR-based method (e.g., real-time quantitative PCR), a sequencing-based method, use of a nucleic acid probe, and/or microscopy. Morphology may be assessed by microscopy. Presence of surface proteins and epitopes thereof may be detected using an antibody or other ligand that binds the surface protein or epitope.

In some embodiments, a replicate in which absence of a population member is identified is assumed to represent 0 individuals of the population member. In some embodiments, a replicate in which presence of a population member is identified is assumed to represent at least one individual of the population member.

In some embodiments, the detectable threshold is a defined number of individuals. In some embodiments, a replicate in which absence of a population member is identified is assumed to represent fewer than the detectable threshold number of individuals of the population member. In some embodiments, a replicate in which absence of a population member is identified is assumed to represent one fewer individual of the population member than the detectable threshold. In some embodiments, a replicate in which presence of a population member is identified is assumed to represent at least the detectable threshold number of individuals of the population member.

In some embodiments, the detectable threshold is a limit of detection. A "limit of detection," as used herein, refers to the lowest number of individuals that can reliably distinguished from background noise, and consequently allow a skilled artisan to conclude that a population member is present. In some embodiments, a replicate in which absence of a population member is identified is assumed to represent fewer individuals than the limit of detection. In some embodiments, a replicate in which absence of a population member is identified is assumed to represent one fewer individual than the limit of detection. In some embodiments, a replicate in which presence of a population member is identified is assumed to represent at least the limit of detection of number of individuals.

The "minimum dilution" refers to the dilution in a series containing the lowest relative concentration of a sample, while the "maximum dilution" refers to the dilution in the series containing the highest relative concentration of the sample. In some embodiments, the population is pre-diluted to prepare a working stock, and the maximum dilution is prepared by diluting the working stock.

In some embodiments, conditions (e.g., extent and number of dilutions, number of replicates at each dilution, incubation conditions, signal of each population member) of the MPN assay are selected to yield (i) at the minimum dilution, at least two population members i and j being present in one or more independent replicates; and (ii) at the maximum dilution, the population members i and j being absent from one or more independent replicates. In some embodiments, conditions (e.g., extent and number of dilutions, number of replicates at each dilution, incubation conditions, signal of each population member) of the MPN assay are selected to yield (i) at the minimum dilution, each population member being present in one or more of the independent replicates; and (ii) at the maximum dilution, each population member being absent from one or more of the independent replicates. The skilled artisan will appreciate that a set of population members being present in (across or among) one or more replicates of a given dilution does not require that a single replicate at the dilution comprise each population member of the set once. Similarly, absence of each population member in a set from (across or among) one or more replicates of a dilution does not require that a single replicate lack each population member of the set.

In some embodiments, conditions are selected to yield a presence of at least two population members i and j among 25-75%, 25-70%, 25-65%, 25-60%, 25-55%, or 25-50% of replicates at the minimum dilution. In some embodiments, conditions are selected to yield an absence of at least two population members i and j among 25-75%, 25-70%, 25-65%, 25-60%, 25-55%, or 25-50% of replicates at the maximum dilution. In some embodiments, conditions are selected to yield 25-75%, 25-70%, 25-65%, 25-60%, 25-55%, or 25-50% in both (i) presence of at least two population members i and j among replicates at the minimum dilution, and (ii) absence of the at least two population members i and j at the maximum dilution.

In some embodiments, conditions are selected to yield a presence of each population member among 25-75%, 25-70%, 25-65%, 25-60%, 25-55%, or 25-50% of replicates at the minimum dilution. In some embodiments, conditions are selected to yield an absence of each population member among 25-75%, 25-70%, 25-65%, 25-60%, 25-55%, or 25-50% of replicates at the maximum dilution. In some embodiments, conditions are selected to yield 25-75%, 25-70%, 25-65%, 25-60%, 25-55%, or 25-50% in both (i) presence of each population member among replicates at the minimum dilution, and (ii) absence of each population member among replicates at the maximum dilution.

In some embodiments, the range of serial dilutions comprises at least 3, 4, 5, 6, 7, 8, 9, 10, 11, 12, 13, 14, 15, 16, 17, 18, 19, 20, 21, 22, 23, or 24 dilutions. In some embodiments, the range comprises 3-24, 3-21, 3-18, 3-15, 3-12, or 3-9 dilutions. In some embodiments, the range comprises 4-24, 5-24, 6-24, 7-24, or 8-24 dilutions. In some embodiments, the range comprises 3-6, 6-9, 9-12, 12-15, 15-18, 18-21, or 21-24 dilutions. In some embodiments, the range comprises 6-8 dilutions. In some embodiments, the range comprises 10-12 dilutions. In some embodiments, the range comprises 14-16 dilutions. In some embodiments, the range comprises 22-24 dilutions.

In some embodiments, each serial dilution comprises at least 3, 4, 5, 6, 7, 8, 9, 10, 11, 12, 13, 14, 15, 16, 17, 18, 19, 20, 21, 22, 23, or 24 independent replicates. In some embodiments, the number of independent replicates at each serial dilution is 3-24, 3-21, 3-18, 3-15, 3-12, or 3-9. In some embodiments, the number of independent replicates at each serial dilution is 4-24, 5-24, 6-24, 7-24, or 8-24. In some embodiments, the number of independent replicates at each serial dilution is 3-6, 6-9, 9-12, 12-15, 15-18, 18-21, or 21-24. In some embodiments, each serial dilution comprises 6-8 independent replicates. In some embodiments, each serial dilution comprises 10-12 independent replicates. In some embodiments, each serial dilution comprises 14-16 independent replicates. In some embodiments, each serial dilution comprises 22-24 independent replicates.

In some embodiments, the number of serial dilutions in a dilution series and number of independent replicates are selected for use in a 96-well (8×12) or 384-well (16×24) plate. The skilled artisan will appreciate that one or more rows or columns in such a plate may be used for controls. For example, a dilution series may comprise 6-8 dilutions and 10-12 independent replicates at each dilution. In some embodiments, the number of dilutions and the number of independent replicates at each dilution are: 6-8 and 10-12; 10-12 and 6-18; 14-16 and 22-24; or 22-24 and 14-16. In some embodiments, each independent replicate comprises incubation in a volume of 400 μL or less, 350 μL or less, 300 μL or less, 250 μL or less, or 200 μL or less. In some embodiments, each independent replicate comprises incubation in volume of 150 μL or less, 125 μL or less, 100 μL or less, 75 μL or less, or 50 μL or less.

In some embodiments, two or more dilutions in a series are separated from each other by an integer multiple of a dilution factor. In some embodiments, each dilution in a series is separated from each other dilution by an integer multiple of a dilution factor. In some embodiments, the dilution factor is at least 2-fold, 3-fold, 3.16-fold, 4-fold, 5-fold, 6-fold, 7-fold, 8-fold, 9-fold, or 10-fold. An "n-fold dilution," as used herein, refers to a dilution made by combining 1 part sample with (n−1) parts diluent. A 10-fold dilution, for example, is made by combining 1 part sample with 9 parts diluent (e.g., 20 μL sample+180 μL diluent), such that the resulting 10-fold dilution contains the sample at 10% of its original concentration. In some embodiments, the dilution factor is at least 20-fold, 30-fold, 31-fold, 31.6-fold, 32-fold, 40-fold, 50-fold, 60-fold, 70-fold, 80-fold, 90-fold, or 100-fold. In some embodiments, the dilution factor is about 2-fold to about 10-fold. In some embodiments, the dilution factor is about 3-fold. In some embodiments, the dilution factor is about 10-fold. The skilled artisan will appreciate that dilution factors between individual dilutions in a series need not be identical, but may be varied.

In some embodiments, a dilution series comprises three or more dilutions in which the relative concentration of sample decreases linearly. See International Publication No. WO 2021/089504. As one example, the relative concentration of sample in five dilutions from a working sample may be 0.1, 0.08, 0.06, 0.04, and 0.02, in contrast to five dilutions prepared by successive 2-fold dilutions (e.g., 0.1, 0.05, 0.025, 0.0125, and 0.00625). In some embodiments, the relative concentration of sample decreases linearly across the entire dilution series.

In some embodiments, the maximum dilution is at least 100, 1,000, 10,000, 100,000, or 1,000,000 times the concentration of the minimum dilution. In some embodiments, the maximum dilution is at least 100, 300, 1,000, 3,000, 10,000, 30,000, 100,000, 300,000, or 1,000,000 times the concentration of the minimum dilution. In some embodiments, the maximum dilution is 100-1,000,000, 1,000-1,000,000, 10,000-1,000,000, or 100,000-1,000,000 times the concentration of the minimum dilution. In some embodiments, the maximum dilution is 100-100,000, 100-10,000, or 100-1,000 times the concentration of the minimum dilution. In some embodiments, the maximum dilution is 100-1,000, 1,000-10,000, 10,000-100,000, or 100,000-1,000,000 times the concentration of the minimum dilution.

The skilled artisan may use any suitable method to estimate the most probable number of individuals from relative concentrations and number of replicates in which presence and absence are detected. As one example, MPN may be estimated using Thomas's formula:

$$MPN/g=(\Sigma g_j)/(\Sigma t_j m_j \Sigma(t_j-g_j)m_j)^{(1/2)},$$

where the summation is over the minimum dilution (with at least one negative replicate) to the maximum dilution (with at least one positive replicate); $\Sigma g_j$ denotes the number of positive tubes in the selected dilutions; $\Sigma t_j m_j$ denotes the grams of sample in all tubes in the selected dilutions, $\Sigma(t_j-g_j)m_j$ denotes the grams of sample in all negative tubes in the selected dilutions. See Thomas, *J Am Water Works Assoc.* 1942. 572-576. Exemplary calculations using this formula are provided by the Food and Drug Administration's Bacteriological Analytical Manual, Appendix 2: Most Probable Number from Serial Dilutions, August 2023. Additional MPN models are provided by Blodgett & Garthright, *Food Microbiol.* 1998. 15(1):91-99, which is incorporated by reference herein for this purpose. In some embodiments, MPN is estimated by maximum likelihood estimation of an assumed probability distribution. Such estimation is described, e.g., by Martini et al., *Microbiol Spectr.* 2024. 12(9):e0394623, which is incorporated by reference herein for this purpose. Suitable tools for calculating MPN are available, e.g., including the R package "MPN" and the related Python package "micrompn." See Meléndez et al., *Microbiol Spectr.* 2024. 12(3):e03578-23; Jarvis et al., *J Appl Microbiol.* 2010. 109(5):1660-1667; Jarvis et al., *J Appl Microbiol.* 2015. 119(3):905.

An "unadjusted" or "uncorrected" MPN abundance, as used herein, refers to the most probable number of individuals of a population member i in a mixed population under an assumption that detection of a signal of the population member i in a replicate of an MPN assay is independent of the presence or absence of any other population members j in the replicate.

In some embodiments, unadjusted MPN abundance of a population member is estimated using a set of parameters consisting of (a) amounts of sample in each serial dilution; (b) the number of independent replicates at each serial dilution in which presence of the population member is identified; (c) the number of independent replicates at each serial dilution in which absence of the population member is identified; (d) an assumed minimum number of individuals present in an independent replicate in which presence of the population member is identified; and (e) an assumed maximum number of individuals present in an independent replicate in which absence of the population member is identified.

Correlation Analysis and Adjusted MPN Abundance Calculation

Figure 2:
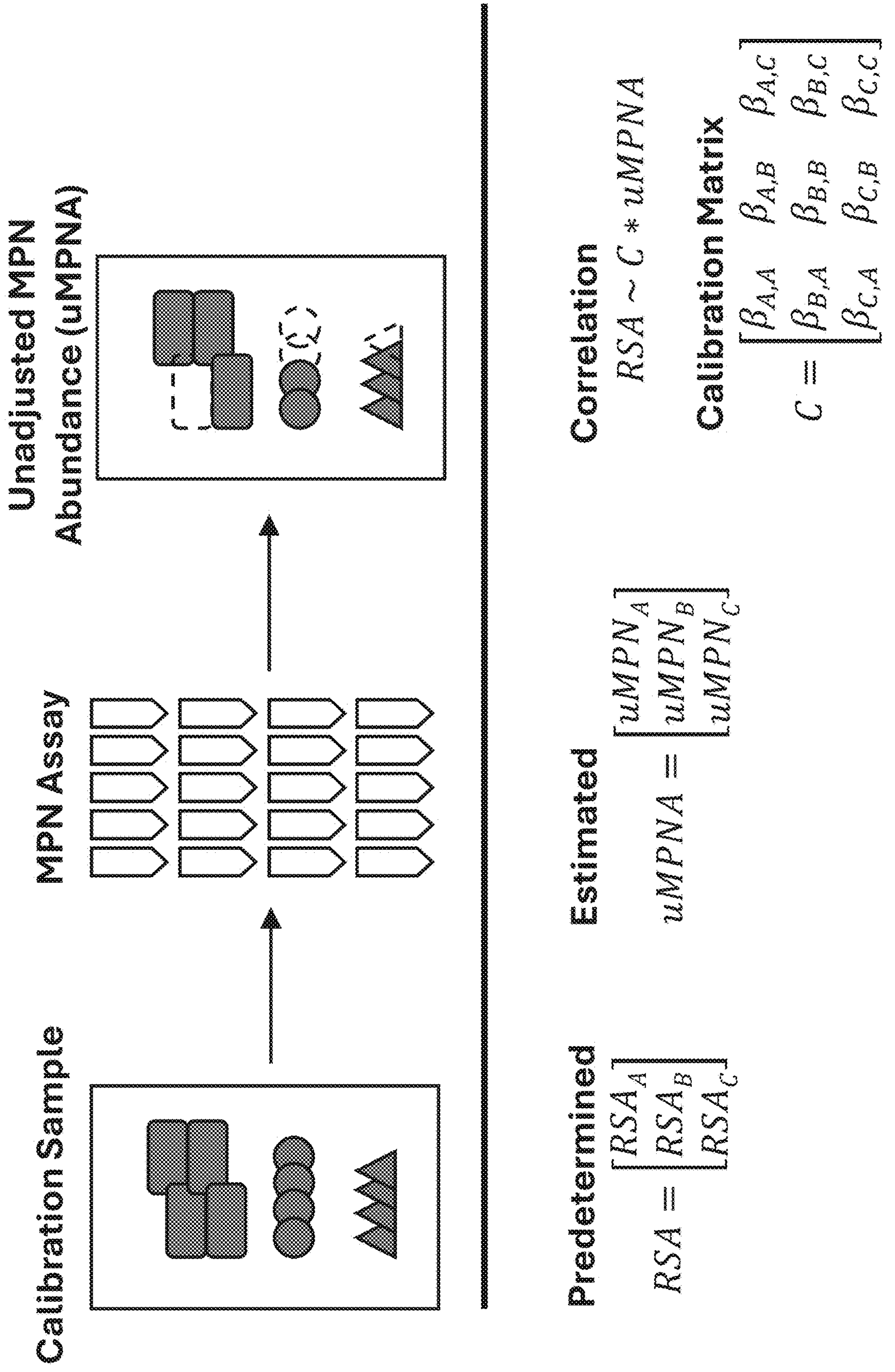
FIG. 2 shows estimation of most probable number (MPN) abundance of population members in the calibration sample from FIG. 1, and derivation of an example of a calibration matrix correlating unadjusted MPN abundance to reference standard abundance.
Figure 3:
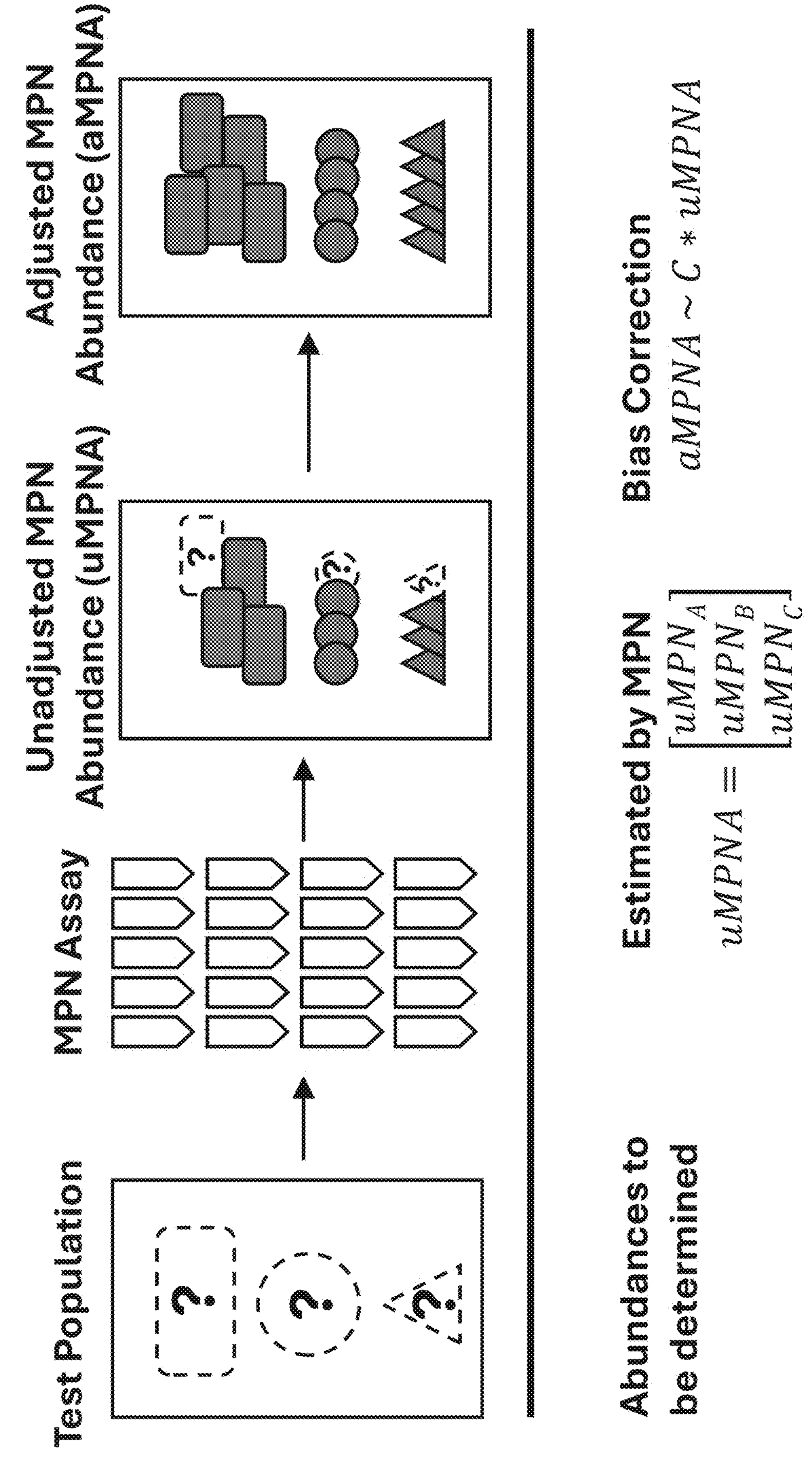
FIG. 3 shows estimation of MPN abundance of members of a test population, and an example of bias correction by transforming unadjusted MPN abundance with the example calibration matrix of FIG. 2, yielding adjusted MPN abundance.

Some aspects contemplate a calibration matrix that correlates reference standard abundances of at least two population members i and j in a calibration sample to unadjusted most probable number (MPN) abundance(s) of one or more of the population members i or j in the calibration sample. One example of such a calibration matrix is shown in FIG. 2. Some aspects contemplate transformation of unadjusted MPN abundances of at least two population members i and j in a mixed population with the calibration matrix to yield adjusted (corrected) MPN abundances of the population members i and j. An example transformation using an example calibration matrix is shown in FIG. 3.

A "calibration matrix," as used herein, refers to a matrix comprising elements that correlate (Y) reference standard abundance values of at least two population members i and j in a calibration sample, with (X) unadjusted MPN abundances of the at least two population members i and j in the calibration sample. "Transformation" with a calibration matrix, as used herein, refers to a mathematical operation in which unadjusted MPN abundances of two or more population members i and j interact with one or more elements of the calibration matrix to yield adjusted MPN abundance(s) of at least one of the population members i or j. An "adjusted" or "corrected" MPN abundance, as used herein, refers to the most probable number of individuals of a population member i in a mixed population after accounting for the effect(s) of one or more other population members j on the population member i during the MPN assay that may affect detection of a signal of the population member i in a given replicate.

Without wishing to be bound by theory, it is envisioned that elements of the calibration matrix reflect synergistic and/or antagonistic interactions between population members i and j during incubation in the MPN assay that bias MPN-based estimates of abundance. For example, in some independent replicates of a dilution series where few individuals of a population member i are present at the start of incubation, the population member i may be driven to extinction by other population members j in those replicates, or the population member i may be prevented from replicating to an extent that a signal of its presence is detectable. In either event, the population member i was present at the start of incubation, but due to lack of signal at the end of incubation, would be identified as absent from one or more replicates, leading to underestimation of its abundance. Conversely, synergistic interactions in which the presence of one or more population members j enhance the growth, replication, metabolism, or gene expression of the population member i may increase the probability of it replicating, metabolizing, or expressing to an extent that a signal of its presence is detectable, or reduce the chance that one or few initially present individuals are lost to stochastic extinction. In those cases, more wells would be identified as containing the population member i, leading to overestimation of its abundance.

Examples of antagonistic interactions include competition between population members i and j. For example, distinct microorganisms in a mixed population may compete through mechanisms including:

- Competition for shared resources, including nutrients and surface area ("nutrient", "resource", or "bottom-up" competition). See, e.g., Honda et al., *Res Sq.* 2023. Rs.3.rs-3462622; Furuichi et al., *Nature.* 2024. 633: 878-886.
- Production of bacteriocins that kill and/or inhibit growth or replication of the microorganism ("interference" or "direct" competition). See, e.g., Cascales et al., *Microbiol Mol Biol Rev.* 2007. 71(1):158-229.

Examples of synergistic interactions include cooperation, quorum sensing, Allee effects, and production of metabolites by one population member i that are consumed by other population members j.

Elements of a calibration matrix may be coefficients of a regression model (regression coefficients). Any suitable regression model may be used to correlate reference standard abundance(s) to unadjusted MPN abundance(s) in one or more calibration samples. In some embodiments, regression coefficients are estimated using the general linear model. In some embodiments, regression coefficients are estimated using a generalized linear model. See McCullagh and Nelder (1982, 2nd edition 1989). The skilled artisan will appreciate that generalized linear models and the general linear model may be used to fit nonlinear relationships between variables. The skilled artisan will appreciate that elements of a calibration matrix may be derived through other suitable means, such as models other than regression. As one example, interactions between population members may be modeled using a system of differential equations.

In the equations below and elsewhere herein (unless otherwise clear from context), "uMPNA" refers to "unadjusted MPN abundance"; "aMPNA" refers to "adjusted MPN abundance"; and "RSA" refers to "reference standard abundance". The subscript or italic suffixes i and j refer to distinct population members. The subscript or suffix k refers to distinct calibration samples where a calibration matrix is derived from results with multiple calibration samples. In some embodiments, the regression coefficients comprise $\beta_{i,j}$ correlating:

$$RSA_{i,k} \sim \sum_{j=1}^{N} (\beta_{i,j} \times uMPNA_{j,k}),$$

and may further comprise additional regression coefficients. In some embodiments, the regression coefficients comprise $\beta_{i,j}$ fitting the equation:

$$RSA_{i,k} = \sum_{j=1}^{N} (\beta_{i,j} \times uMPNA_{j,k}),$$

where the equation does not include other regression coefficients accounting for interactions between population members i and j.

In some embodiments, the regression coefficients comprise $\beta_i$ and $\beta_{i,j}$ correlating:

$$RSA_{i,k} \sim [\beta_i \times uMPNA_{i,k}] + \sum_{j=1}^{N} [\beta_{i,j} \times (uMPNA_{i,k} - uMPNA_{j,k})],$$

wherein (uMPNAi,k−uMPNAj,k) is assumed to be 0 when (uMPNAi,k−uMPNAj,k)<0, and may further comprise additional coefficients. In some embodiments, the regression coefficients comprise $\beta_i$ and $\beta_{i,j}$ fitting the equation:

$$RSA_{i,k} = [\beta_i \times uMPNA_{i,k}] + \sum_{j=1}^{N} [\beta_{i,j} \times (uMPNA_{i,k} - uMPNA_{j,k})],$$

wherein (uMPNAi,k−uMPNAj,k) is assumed to be 0 when (uMPNAi,k−uMPNAj,k)<0, where the equation does not include other regression coefficients accounting for interactions between population members i and j. This model accounts for the initial abundance of the population member i and the population member j. For example, if the population member i is present at higher abundance than the population member j, then at higher dilutions in the series, more replicates of the MPN assay will comprise the population member i but not the population member j. These replicates provide information about the abundance of the population member i without interference from the population member j, thereby decreasing the influence of the population member j on the estimated abundance of the population member i.

In some embodiments, conditions of the MPN assay and the number of calibration samples are selected to yield, for at least one population member, a standard error of the mean that is no more than 25%, no more than 20%, no more than 15%, no more than 10%, or no more than 5% of the estimated adjusted MPN abundance of the population member in the calibration samples. In some embodiments, the conditions and number of calibration samples are selected to yield, for a majority of population members, a standard error of the mean that is no more than 25%, no more than 20%, no more than 15%, no more than 10%, or no more than 5% of the estimated adjusted MPN abundance in the calibration samples. In some embodiments, the conditions and number of calibration samples are selected to yield, for each population member, a standard error of the mean that is no more than 25%, no more than 20%, no more than 15%, no more than 10%, or no more than 5% of the estimated adjusted MPN abundance in the calibration samples.

In some embodiments, the conditions and number of calibration samples are selected to yield, for at least one population member, a 95% confidence interval of adjusted MPN abundance with lower and upper bounds that are, respectively: (1) no less than 75% and no more than 125% of the estimated adjusted MPN abundance; (2) no less than 80% and no more than 120% of the estimated adjusted MPN abundance; (3) no less than 85% and no more than 115% of the estimated adjusted MPN abundance; (4) no less than 90% and no more than 110% of the estimated adjusted MPN abundance; or (5) no more than 95% and no more than 105% of the estimated adjusted MPN abundance, of the population member in the calibration samples.

In some embodiments, the conditions and number of calibration samples are selected to yield, for a majority of population members, a 95% confidence interval of adjusted MPN abundance with lower and upper bounds that are, respectively: (1) no less than 75% and no more than 125% of the estimated adjusted MPN abundance; (2) no less than 80% and no more than 120% of the estimated adjusted MPN abundance; (3) no less than 85% and no more than 115% of the estimated adjusted MPN abundance; (4) no less than 90% and no more than 110% of the estimated adjusted MPN abundance; or (5) no more than 95% and no more than 105% of the estimated adjusted MPN abundance, of the population members in the calibration samples.

In some embodiments, the conditions and number of calibration samples are selected to yield, for each population member, a 95% confidence interval of adjusted MPN abundance with lower and upper bounds that are, respectively: (1) no less than 75% and no more than 125% of the estimated adjusted MPN abundance; (2) no less than 80% and no more than 120% of the estimated adjusted MPN abundance; (3) no less than 85% and no more than 115% of the estimated adjusted MPN abundance; (4) no less than 90% and no more than 110% of the estimated adjusted MPN abundance; or (5) no more than 95% and no more than 105% of the estimated adjusted MPN abundance, of the population member in the calibration samples.

In some embodiments, the conditions and number of calibration samples are selected to yield, for at least one population member, a 95% confidence interval of adjusted MPN abundance in the calibration samples with an upper bound that is no more than 5 times, no more than 4 times, no more than 3 times, or no more than 2 times its lower bound, where the calibration matrix is not derived using logarithmically transformed abundance values.

In some embodiments, the conditions and number of calibration samples are selected to yield, for a majority of population members, a 95% confidence interval of adjusted MPN abundance in the calibration samples with an upper bound that is no more than 5 times, no more than 4 times, no more than 3 times, or no more than 2 times its lower bound, where the calibration matrix is not derived using logarithmically transformed abundance values.

In some embodiments, the conditions and number of calibration samples are selected to yield, for each population member i, a 95% confidence interval of adjusted MPN abundance with an upper bound that is no more than 5 times, no more than 4 times, no more than 3 times, or no more than 2 times its lower bound, where the calibration matrix is not derived using logarithmically transformed abundance values.

In some embodiments, the calibration matrix is derived using abundance values that have been logarithmically transformed. In some embodiments, the calibration matrix is derived using ln- or $\log_{10}$-transformed abundances. In some embodiments, the calibration matrix is derived using ln-transformed abundances. In some embodiments, the calibration matrix is derived using $\log_{10}$-transformed abundances.

In some embodiments, for at least one population member, the conditions of the MPN assay, and number of calibration samples are chosen to yield estimated adjusted MPN abundance with a standard error of the mean that is no more than 25%, no more than 20%, no more than 15%, no more than 10%, or no more than 5% of the estimated adjusted MPN abundance. In some embodiments, for at least two population members i and j, the conditions of the MPN assay, and number of calibration samples are chosen to yield estimated adjusted MPN abundances with a standard errors of the mean that are no more than 25%, no more than 20%, no more than 15%, no more than 10%, or no more than 5% of the respective estimated adjusted MPN abundance of the population members i and j. In some embodiments, for a majority of population members, the conditions of the MPN assay, and number of calibration samples are chosen to yield estimated adjusted MPN abundance with a standard error of the mean that is no more than 25%, no more than 20%, no more than 15%, no more than 10%, or no more than 5% of the estimated adjusted MPN abundance. In some embodiments, for each population member, the conditions of the MPN assay, and number of calibration samples are chosen to yield estimated adjusted MPN abundance with a standard error of the mean that is no more than 25%, no more than 20%, no more than 15%, no more than 10%, or no more than 5% of the estimated adjusted MPN abundance.

In some embodiments, for at least one population member, the conditions and number of calibration samples are chosen such that the lower and upper bounds of a 95% confidence interval of adjusted MPN abundance are, respectively: (1) no less than 75% and no more than 125% of the estimated adjusted MPN abundance; (2) no less than 80% and no more than 120% of the estimated adjusted MPN abundance; (3) no less than 85% and no more than 115% of the estimated adjusted MPN abundance; (4) no less than 90% and no more than 110% of the estimated adjusted MPN abundance; or (5) no more than 95% and no more than 105% of the estimated adjusted MPN abundance. In some embodiments, the conditions and number of calibration samples are chosen such that the defined standard error of the mean or confidence interval bounds apply for at least two population members i and j. In some embodiments, the conditions and number of calibration samples are chosen such that the defined standard error of the mean or confidence interval bounds apply for a majority of population members. In some embodiments, the conditions and number of calibration samples are chosen such that the defined standard error of the mean or confidence interval bounds apply for each population member. Calculation of summary statistics, including standard deviation and confidence intervals, and selection of sample size suitable for achieving a given standard error of the mean, are within the level of ordinary skill in the art.

In some embodiments, for at least one population member, deviation of (i) adjusted MPN abundance from (ii) reference standard abundance in the calibration sample is less than deviation of (i) unadjusted MPN abundance from (ii) reference standard abundance in the calibration sample. In some embodiments, for a majority of population members, deviation of adjusted MPN abundance from reference standard abundance is less than deviation of unadjusted MPN abundance from reference standard abundance. In some embodiments, for each population member, deviation of adjusted MPN abundance from reference standard abundance is less than deviation of unadjusted MPN abundance from reference standard abundance. As used herein, "deviation" between an MPN abundance and reference standard abundance refers to the absolute value of the difference between the MPN abundance and the reference standard abundance.

In some embodiments, for the set of at least two population members i and j, mean deviation of adjusted MPN abundance from reference standard abundance in the calibration sample is less than mean deviation of unadjusted MPN abundance from reference standard abundance in the calibration sample. In some embodiments, for the set of a majority of population members, mean deviation of adjusted MPN abundance from reference standard abundance in the calibration sample is less than mean deviation of unadjusted MPN abundance from reference standard abundance in the calibration sample. In some embodiments, for the set of all population members, mean deviation of adjusted MPN abundance from reference standard abundance in the calibration sample is less than mean deviation of unadjusted MPN abundance from reference standard abundance in the calibration sample.

In some embodiments, for at least one population member, a coefficient of variation (CV) of adjusted MPN abundance of the population member is no more than the CV of unadjusted MPN abundance of the population member. In some embodiments, for at least two population members i and j, the CV of adjusted MPN abundance is no more than the CV of unadjusted MPN abundance. In some embodiments, for a majority of population members, the CV of adjusted MPN abundance is no more than the CV of unadjusted MPN abundance. In some embodiments, for each population member, the CV of adjusted MPN abundance is no more than the CV of unadjusted MPN abundance.

In some embodiments, for at least one population member, a CV of adjusted MPN abundance of the population member is less than the CV of unadjusted MPN abundance of the population member. In some embodiments, for at least two population members i and j, the CV of adjusted MPN abundance is less than the CV of unadjusted MPN abundance. In some embodiments, for a majority of population members, the CV of adjusted MPN abundance is less than the CV of unadjusted MPN abundance. In some embodiments, for each population member, the CV of adjusted MPN abundance is less than the CV of unadjusted MPN abundance.

In some embodiments, CVs are calculated using abundance values that have been logarithmically transformed. In some embodiments, CVs are calculated using ln- or $\log_{10}$-transformed abundances. In some embodiments, CVs are calculated using ln-transformed abundances. In some embodiments, CVs are calculated using $\log_{10}$-transformed abundances.

Compositions with Defined Abundance Tolerances

In some embodiments, a composition comprises at least one population member within a defined abundance tolerance. In some embodiments, a composition comprises at least two population members i and j within a defined abundance tolerance. In some embodiments, a composition comprises a majority of population members within a defined abundance tolerance. In some embodiments, a composition comprises each population member within a defined abundance tolerance. Some embodiments relate to a plurality of such compositions.

In some embodiments, a composition is formulated or packaged for administration to a subject in need thereof at a dose of one or more population members within a defined abundance tolerance. In some embodiments, a composition is formulated or packaged for administration to a subject in need thereof at a dose of at least population members i and j within a defined abundance tolerance. In some embodiments, a composition is formulated or packaged for administration to a subject in need thereof at a dose of a majority of population members within a defined abundance tolerance. In some embodiments, a composition is formulated or packaged for administration to a subject in need thereof at a dose of each population member within a defined abundance tolerance. Some embodiments relate to a plurality of such compositions.

A "defined abundance tolerance" of a population member, as used herein, refers to a range of abundance at which the population member is intended or represented to be present in the composition. Representations of population members' abundance may take the form of, e.g., specifications, manufacturing tolerances, or other quality control criteria for preparing a composition with a specified range of population members' abundance; product packaging describing a composition as containing population members in specified instructions for use at a specified dose range.

A defined abundance tolerance may have a specified minimum abundance (a "defined abundance floor"), a specified maximum abundance (a "defined abundance ceiling"), or both. In a composition formulated for administration at a specified dose range of a population member, for example, the defined abundance floor is the lower bound of the dose range (e.g., $1.0*10^6$ CFU for a dose range of $1.0*10^6$ to $5.0*10^6$ CFU), and the defined abundance ceiling is the upper bound (e.g., $5*10^6$ CFU in the same example). The skilled artisan will appreciate that a defined abundance tolerance may be open-ended (e.g., having a defined abundance floor without a defined abundance ceiling).

In some embodiments, adjusted MPN abundance remains within the defined abundance tolerance for a defined period of time. In some embodiments, the defined period of time is up to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 months. In some embodiments, the defined period of time is 6-60, 12-60, 18-60, 24-60, 30-60, 36-60, 42-60, 48-60, or 54-60 months. In some embodiments, the defined period of time is 1, 2, 3, 4, or 5 years. In some embodiments, the defined period of time is 1 year. In some embodiments, the defined period of time is 6 months.

In some embodiments, a method comprises identifying a composition as comprising at least one population member within the defined abundance tolerance for a defined period of time. In some embodiments, the method comprises identifying the composition as comprising at least two population members i and j within the defined abundance tolerance for a defined period of time. In some embodiments, the method comprises identifying the composition as comprising a majority of population members within the defined abundance tolerance for a defined period of time. In some embodiments, a method comprises identifying a composition as comprising each population member within the defined abundance tolerance for a defined period of time. In some embodiments, the defined period of time is up to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 months. In some embodiments, the defined period of time is 6-60, 12-60, 18-60, 24-60, 30-60, 36-60, 42-60, 48-60, or 54-60 months. In some embodiments, the defined period of time is 1, 2, 3, 4, or 5 years. In some embodiments, the defined period of time is 1 year. In some embodiments, the defined period of time is 6 months. In some embodiments, a method further comprises administering the composition to a subject in need thereof.

In some embodiments, a method comprises formulated or packaging the composition for administration to a subject in need thereof at a dose of at least one population member within a defined abundance tolerance. In some embodiments, the composition is formulated or packaged for administration at a dose of at least two population members i and j within a defined abundance tolerance. In some embodiments, the composition is formulated or packaged for administration at a dose of a majority of population members within a defined abundance tolerance. In some embodiments, the composition is formulated or packaged for administration at a dose of each population member within a defined abundance tolerance. Some embodiments relate to a composition made by such a method.

In some embodiments, maintenance of adjusted MPN abundance within a defined abundance tolerance is conditioned on storage under defined conditions. In some embodiments, the storage is at about 25° C. In some embodiments, the storage is at 2° C. to 8° C. In some embodiments, the storage is at about −20° C. In some embodiments, the storage is at less than −70° C. In some embodiments, the storage is at about −80° C. In some embodiments, the storage is in liquid nitrogen.

In some embodiments, maintenance of adjusted MPN abundance within a defined abundance tolerance is conditioned on the population member being preserved. In some embodiments, the population member has been actively dried prior to storage. In some embodiments, the population member has been lyophilized or spray-dried. In some embodiments, the population member has been lyophilized.

Population Types and Measurements

In some embodiments, at least two population members i and j belong to the same species. In some embodiments, a majority of population members belong to the same species. In some embodiments, each population member belongs to the same species.

In some embodiments, at least two population members i and j belong to different species. In some embodiments, a majority of population members do not belong to the same species. In some embodiments, each population member i belongs to a different species from each population member j.

In some embodiments, at least two population members i and j belonging to the same species belong to different subgroups within the species. Species may be further divided into subgroups, with population members of the same species belonging to the same or different subgroups. Multiple taxonomic frameworks recognize a subspecies as a further division, for example, with *Lactobacillus delbrueckii* including six subspecies. Other bacteria, including *Escherichia coli* and *Streptococcus pneumoniae*, are divided into serotypes representing antigenically distinct clusters. Influenza A viruses, as another example, are divided into subtypes based on the phylogenetics of genome segments encoding hemagglutinin (HA) and neuraminidase (NA) proteins, and subtypes are further divided into distinct clades. In some embodiments, for the set of population members belonging to the same species, each population member in the set belongs to a different subgroup from each other population member in the set.

Bacterial Populations

In some embodiments, at least one population member is a bacterial strain. In some embodiments, at least two population members i and j are bacterial strains. In some embodiments, a majority of population members are bacterial strains. In some embodiments, a population is a bacterial population, where each population member i is a distinct bacterial strain from each other population member j. Populations of bacterial strains are described below in the section entitled "Combinations of Bacterial Strains."

In some embodiments, for the set of bacterial strains in the population, each bacterial strain i comprises a genome sharing less than 99.99% average nucleotide identity (ANI) or an alignment fraction (AF) of less than 90% with the genome of each other bacterial strain j. In some embodiments, for the set of bacterial strains in the population, each bacterial strain i comprises a 16S rRNA gene sequence with less than 100% sequence identity to each 16S rRNA gene sequence of each other bacterial strain j.

In some embodiments, at least two bacterial strains i and j belong to the same species cluster. In some embodiments, a majority of bacterial strains belong to the same species cluster. In some embodiments, each bacterial strain belongs to the same species cluster.

In some embodiments, at least two bacterial strains i and j belong to different species clusters. In some embodiments, a majority of bacterial strains do not belong to the same species cluster. In some embodiments, each bacterial strain i belongs to a different species cluster from each bacterial strain j.

In some embodiments, reference standard abundance of bacterial strains is measured in colony-forming units (CFUs). See, e.g., Ben-David & Davidson, *J Microbiol Methods*. 2014. 107:214-221; Martins et al., *J Ind Microbiol Biotechnol*. 2024. 51:kuae029; Martini et al., *Microbiol Spectr*. 2024. 12(9):e0394623.

In some embodiments, reference standard abundance of bacterial strains is measured in bacterial genome copy number. In some embodiments, genome copy number is measured by digital PCR (dPCR). See Quan et al., *Sensors (Basel)*. 2018. 18(4):1271. In some embodiments, genome copy number is measured by digital droplet PCR (ddPCR). See Hindson et al., *Anal Chem*. 2011. 83(22):8604-8610 (describing ddPCR generally); Kim et al., *Food Microbiol*. 2023. 113:104265 (describing ddPCR in quantitation of bacteria).

In some embodiments, reference standard abundance is measured by real-time quantitative PCR (qPCR) in combination with a standard curve. See Garzarelli et al., *Heliyon*. 2023. 9(5):e16229. Standard curves in real-time qPCR provide a basis from which to convert cycle threshold (Ct) values to another unit of measure, such as genome copy number or CFUs.

In some embodiments, the signal for a bacterial strain i in the MPN assay is a nucleic acid comprising a nucleotide sequence that is present in the bacterial strain i but not in any other bacterial strain j. In some embodiments, the nucleotide sequence is present on a chromosome of the bacterial strain. In some embodiments, the nucleotide sequence is a 16S rRNA gene sequence. The presence of nucleic acids above a detectable threshold may be detected using any suitable method. In some embodiments, the nucleic acids are detected by a method selected from the group consisting of PCR, real-time quantitative PCR (qPCR), droplet PCR, digital droplet PCR, rolling circle amplification, a sequencing-based method, and fluorescent in situ hybridization. See, e.g., Garzarelli et al., *Heliyon.* 2023. 9(5):e16229 (describing qPCR).

In some embodiments, the signal for a bacterial strain i in the MPN assay is a metabolite produced by the bacterial strain i but not any other bacterial strain j. In some embodiments, the signal for each bacterial strain i in the MPN assay is a metabolite consumed by the bacterial strain i but not any other bacterial strain j. Changes in concentration of a metabolite may be detected using any suitable method. In some embodiments, metabolite concentrations are detected by a spectroscopy selected from the group consisting of nuclear magnetic resonance (NMR) spectroscopy, mass spectrometry, and Fourier transform infrared (FTIR) spectroscopy.

In some embodiments, the signal for a bacterial strain i in the MPN assay is a morphology that distinguishes the bacterial strain i from each other bacterial strain j. Morphology may be a combination of multiple characteristics, such as Gram staining (e.g., Gram-positive), cell shape (e.g., rods), arrangement (e.g., chains), flagellation, and other surface markers. In some embodiments, morphology is detected using microscopy. In some embodiments, morphology is assessed by a blinded observer.

In some embodiments, the signal of a bacterial strain i is a surface protein expressed by that bacterial strain and not on any other cell type j. Presence of a surface protein may be detected using any suitable method. In some embodiments, presence of a surface protein is detected by microscopy. In some embodiments, presence of a surface protein is detected using one or more antibodies specific to the surface protein.

In some embodiments, one or more bacterial strains are obligate (strict) anaerobes, and reagents used to measure reference standard abundance and/or MPN abundance are pre-reduced in an anaerobic environment for a duration sufficient to eliminate their negative influence on growth of the strict anaerobes. An "obligate anaerobe," as used herein, refers to a microorganism that cannot grow, or grows only minimally, by exposure to atmospheric concentrations of oxygen. Without wishing to be bound by theory, it is posited that pre-reduction reduces the concentration of oxygen in reagents, such that they exert less oxidative stress, including killing, on the obligate anaerobes that are measured using such reagents. In some embodiments, the pre-reduced reagents comprise diluent and culture media. In some embodiments, the diluent is the culture media.

In some embodiments, the diluent and/or culture media comprises an antioxidant. In some embodiments, the diluent and culture media comprise the same antioxidant. Non-limiting examples of antioxidants include inulin, riboflavin, and cysteine. In some embodiments, the antioxidant is cysteine.

In some embodiments, the culture media and/or diluent comprise a reducing agent. In some embodiments, the diluent and culture media comprise the same antioxidant. Non-limiting examples of reducing agents include sodium metabisulfite and citric acid. In some embodiments, the reducing agent is sodium metabisulfite.

Viral Populations

In some embodiments, at least one population member is a virus. In some embodiments, at least two population members i and j are viruses. In some embodiments, a majority of population members are viruses. In some embodiments, a population is a viral population, where each population member i is a distinct virus from each other population member j.

In some embodiments, at least two viruses i and j belong to the same species. In some embodiments, a majority of viruses belong to the same species. In some embodiments, each virus belongs to the same species.

In some embodiments, at least two viruses i and j belong to different species. In some embodiments, a majority of viruses do not belong to the same species. In some embodiments, each virus i belongs to a different species from each virus j.

In some embodiments, reference standard abundance of viruses is measured in plaque-forming units (PFUs). See Baer & Kehn-Hall, *J Vis Exp.* 2014. 4(93):e52065. PFUs may be measured using any cell type on which the virus can form plaques (e.g., MDCK cells for influenza viruses).

In some embodiments, reference standard abundance of viruses is measured in viral genome or genome segment copy number. In some embodiments, genome or genome segment copy number is measured by digital PCR (dPCR). See Quan et al., *Sensors* (*Basel*). 2018. 18(4):1271 (describing dPCR). In some embodiments, genome or genome segment copy number is measured by digital droplet PCR (ddPCR). See Hindson et al., *Anal Chem.* 2011. 83(22): 8604-8610 (describing ddPCR generally); Strain et al., *PLoS One.* 2013. 8(4):e55943 (describing ddPCR quantification of viral DNA). In some embodiments, reference standard abundance is measured by real-time quantitative PCR (qPCR) in combination with a standard curve. See Watzinger et al., *Mol Aspects Med.* 2006. 27(2-3):254-298. Standard curves in real-time qPCR provide a basis from which to convert cycle threshold (Ct) values to another unit of measure, such as genome or genome segment copy number or PFUs.

In some embodiments, the signal for a virus i in the MPN assay is a nucleic acid comprising a nucleotide sequence that is present in the virus i but not in any other virus j. The presence of nucleic acids above a detectable threshold may be detected using any suitable method. In some embodiments, the nucleic acids are detected by a method selected from the group consisting of PCR, quantitative real-time PCR, digital droplet PCR, rolling circle amplification, and fluorescent in situ hybridization.

In some embodiments, the signal for a virus i in the MPN assay is a surface protein comprising an epitope that is present on that virus but not any other virus j. Surface proteins and epitopes thereof may be detected using any suitable method. In some embodiments, presence of a surface protein or epitope thereof is detected by microscopy. In some embodiments, presence of a surface protein or epitope thereof is detected using one or more antibodies specific to the surface protein. See, e.g., Mills et al., *J Clin Microbiol.* 1989. 27(11):2505-2508.

In some embodiments, a composition comprising a virus is a vaccine. In some embodiments, a composition comprising a virus is for therapeutic use.

Eukaryotic Cell Populations

In some embodiments, at least one population member is a eukaryotic cell. In some embodiments, at least two population members i and j are eukaryotic cell types. In some embodiments, a majority of population members are eukaryotic cell types. In some embodiments, a population is a eukaryotic cell population, wherein each population member i is a distinct eukaryotic cell type from each other population member j.

In some embodiments, at least two eukaryotic cell types i and j are cells of eukaryotes belonging to the same species. In some embodiments, a majority of eukaryotic cell types are cells of eukaryotes belonging to the same species. In some embodiments, each population member is a cell type of the same eukaryotic species.

In some embodiments, at least two eukaryotic cell types i and j are cells of eukaryotes belonging to different species. In some embodiments, a majority of eukaryotic cell types are cells of eukaryotes that do not belong to the same species. In some embodiments, each eukaryotic cell type i is a cell of a different eukaryotic species than each other population member j.

In some embodiments, reference standard abundance of eukaryotic cells is measured in cell number. In some embodiments, reference standard abundance of eukaryotic cells is measured in proportional abundance. In some embodiments, reference standard abundance of eukaryotic cells is measured in genome copy number.

In some embodiments, genome copy number is measured by digital PCR (dPCR). See Quan et al., *Sensors* (*Basel*). 2018. 18(4):1271. In some embodiments, genome copy number is measured by digital droplet PCR (ddPCR). See Hindson et al., *Anal Chem.* 2011. 83(22):8604-8610 (describing ddPCR generally).

In some embodiments, reference standard abundance is measured by real-time quantitative PCR (qPCR) in combination with a standard curve. Standard curves in real-time qPCR provide a basis from which to convert cycle threshold (Ct) values to another unit of measure, such as genome copy number or cell number.

In some embodiments, the signal for a eukaryotic cell type i in the MPN assay is a nucleic acid comprising a nucleotide sequence that is present in the eukaryotic cell type i but not in any other eukaryotic cell type j. In some embodiments, the nucleotide sequence is present on a chromosome of the eukaryotic cell type. The presence of nucleic acids above a detectable threshold may be detected using any suitable method. In some embodiments, the nucleic acids are detected by a method selected from the group consisting of PCR, real-time quantitative PCR (qPCR), droplet PCR, digital droplet PCR, rolling circle amplification, and fluorescent in situ hybridization. See, e.g., Garzarelli et al., *Heliyon.* 2023. 9(5):e16229 (describing qPCR).

In some embodiments, the signal for a eukaryotic cell type i in the MPN assay is a metabolite produced by the eukaryotic cell type i but not any other eukaryotic cell type j. In some embodiments, the signal for each eukaryotic cell type i in the MPN assay is a metabolite consumed by the eukaryotic cell type i but not any other eukaryotic cell type j. Changes in concentration of a metabolite may be detected using any suitable method. In some embodiments, metabolite concentrations are detected by a spectroscopy selected from the group consisting of nuclear magnetic resonance (NMR) spectroscopy, mass spectrometry, and Fourier transform infrared (FTIR) spectroscopy.

In some embodiments, the signal for a eukaryotic cell type i in the MPN assay is a morphology that distinguishes the eukaryotic cell type i from each other eukaryotic cell type j. Morphology may be a combination of multiple characteristics, such as single or multicellularity; size; shape; organelle presence; and presence of one or more surface markers. In some embodiments, morphology is detected using microscopy. In some embodiments, morphology is assessed by a blinded observer.

In some embodiments, the signal of a eukaryotic cell type i is a surface protein expressed by that eukaryotic cell type and not on any other cell type j. Presence of a surface protein may be detected using any suitable method. In some embodiments, presence of a surface protein is detected by microscopy. In some embodiments, presence of a surface protein is detected using one or more antibodies specific to the surface protein.

Animal Cell Populations

In some embodiments, at least one population member is an animal cell. In some embodiments, at least two population members i and j are animal cell types. In some embodiments, a majority of population members are animal cell types. In some embodiments, a population is an animal cell population, where each population member i is a distinct animal cell type from each other population member j. In some embodiments, the animal is a vertebrate, a mammal, a mouse, or a human. In some embodiments, the animal is a mammal. In some embodiments, the animal is a mouse. In some embodiments, the animal is a human.

In some embodiments, the animal is a mammal, and each population member is a stem cell; a hematopoietic cell; a myeloid cell; a neutrophil, monocyte, macrophage, dendritic cell, eosinophil, or basophil; a lymphoid cell; or a natural killer cell, B cell, or T cell.

In some embodiments, one or more population members are stem cells. In some embodiments, one or more population members are hematopoietic stem cells. In some embodiments, one or more population members are induced pluripotent stem cells.

In some embodiments, one or more population members are myeloid cells. In some embodiments, one or more population members are neutrophils. In some embodiments, one or more population members are monocytes. In some embodiments, one or more population members are macrophages. In some embodiments, one or more population members are dendritic cells. In some embodiments, one or more population members are eosinophils. In some embodiments, one or more population members are basophils.

In some embodiments, one or more population members are lymphoid cells. In some embodiments, one or more population members are natural killer cells. In some embodiments, one or more population members are B cells. In some embodiments, one or more population members are T cells. In some embodiments, one or more population members are CD4+ T cells.

In some embodiments, one or more population members are CD8+ T cells. In some embodiments, one or more population members are T cells expressing one or more chimeric antigen receptors (CARs). In some embodiments, one or more population members are T cells expressing one or more heterologous T cell receptors (TCRs). In some embodiments, one or more population members are regulatory T cells (Tregs). In some embodiments, one or more population members are CD4+ FOXP3+ Tregs. In some embodiments, one or more population members are CD8+ FOXP3+ Tregs. In some embodiments, one or more population members are NK-T cells.

In some embodiments, reference standard abundance of animal cells is measured in cell number. In some embodiments, reference standard abundance of animal cells is measured in proportional abundance combined with total cell abundance.

In some embodiments, proportional abundance is measured by flow cytometry. See, e.g., McKinnon, *Curr Protoc Immunol.* 2018. 120:5.1.1-5.1.11. In some embodiments, cell number is calculated using proportional abundance in combination with an independent measure of total cell abundance. Total cell abundance may be measured using any suitable method, such as by an automated cell counter or manual counting with a haemocytometer.

In some embodiments, the signal of an animal cell type i is a surface protein expressed by that animal cell type and not on any other cell type j. Non-limiting examples of suitable surface proteins include cluster of differentiation (CD) molecules (e.g., CD3, CD4, CD8, CD19, CD33, CD34, CD56) and chemokine receptors (e.g., CXCR4, CCR5). Presence of a surface protein may be detected using any suitable method. In some embodiments, presence of a surface protein is detected by microscopy. In some embodiments, presence of a surface protein is detected using one or more antibodies specific to the surface protein.

In some embodiments, a composition comprising an animal cell population is formulated or packaged for administration to a subject in need thereof. In some embodiments, the subject is an animal of the same species as the species to which animal cells of the population belong. In some embodiments, one or more population members of the animal cell population are allogeneic to the subject. In some embodiments, each population member is allogeneic to the subject. In some embodiments, the subject is a human.

Combinations of Bacterial Strains

Some aspects relate to combinations comprising one or more isolated or purified bacterial strains. In some embodiments, the combination comprises one or more isolated bacterial strains belonging to *Clostridium* clusters IV, XIVa, XVII, and/or XVIII. In some embodiments, the combination comprises one or more isolated bacterial strains belonging to *Clostridium* cluster IV. In some embodiments, the combination comprises one or more isolated bacterial strains belonging to *Clostridium* cluster XIVa. In some embodiments, the combination comprises one or more isolated bacterial strains belonging to *Clostridium* cluster XVII. In some embodiments, the combination comprises one or more isolated bacterial strains belonging to *Clostridium* cluster XVIII. In some embodiments, one or more bacterial strains of the combination are human intestinal commensal or mutualist bacteria. A "commensal" bacterial strain, as used herein, is a bacterial strain that is not pathogenic in a human subject. Commensal bacterial strains, as defined herein, include bacteria that exhibit a mutually beneficial relationship with the human subject (i.e., the term commensal does not exclude mutualists).

Some embodiments relate to pharmaceutical compositions comprising a combination of bacterial strains. Some embodiments relate to methods of administering a combination of bacterial strains to a subject. Some embodiments relate to kits comprising a combination of bacterial strains. The skilled artisan will appreciate that because bacterial strains may colonize the gastrointestinal tract of a subject and exert a therapeutic effect through their presence in the gastrointestinal tract, it is not necessary that all bacterial strains administered to the subject be present in a single dosage form (e.g., a single capsule comprising all bacterial strains of the combination).

Bacterial Strains Having Genomes with ANI to Reference Genomes

In some embodiments, a combination comprises at least 1, 2, 3, 4, 5, 6, 7, 8, 9, 10, 11, 12, 13, 14, 15, or 16 bacterial strains, each of the at least 1 bacterial strains comprising a genome having at least a minimum average nucleotide identity (ANI) (e.g., at least 95.0%, at least 98.0%, at least 99.0%, at least 99.5%, or at least 99.99%) to a Reference genome selected from a list provided in Table 1.

In some embodiments, bacterial strains of a combination collectively comprise genomes having at least a minimum ANI to at least 1, 2, 3, 4, 5, 6, 7, 8, 9, 10, 11, 12, 13, 14, 15, or 16 of the Reference genomes selected from a list provided in Table 1.

In some embodiments, bacterial strains of a combination collectively comprise at least N=1, 2, 3, 4, 5, 6, 7, 8, 9, 10, 11, 12, 13, 14, 15, or 16 genomes, each of the N genomes having at least a minimum ANI to one of N Reference genomes selected from a list provided in Table 1, and the combination comprises at least N bacterial strains. In some embodiments, N is 16. In some embodiments, N is 8.

In some embodiments, a combination comprises a bacterial strain comprising a genome having at least 95.0% ANI to the reference genome of SEQ ID NO: 1, a bacterial strain comprising a genome having at least 95.0% ANI to the reference genome of SEQ ID NO: 3, a bacterial strain comprising a genome having at least 95.0% ANI to the reference genome of SEQ ID NO: 4, a bacterial strain comprising a genome having at least 95.0% ANI to the reference genome of SEQ ID NO: 6, a bacterial strain comprising a genome having at least 95.0% ANI to the reference genome of SEQ ID NO: 7, a bacterial strain comprising a genome having at least 95.0% ANI to the reference genome of SEQ ID NO: 9, a bacterial strain comprising a genome having at least 95.0% ANI to the reference genome of SEQ ID NO: 13, a bacterial strain comprising a genome having at least 95.0% ANI to the reference genome of SEQ ID NO: 14, a bacterial strain comprising a genome having at least 95.0% ANI to the reference genome of SEQ ID NO: 15, a bacterial strain comprising a genome having at least 95.0% ANI to the reference genome of SEQ ID NO: 16, a bacterial strain comprising a genome having at least 95.0% ANI to the reference genome of SEQ ID NO: 18, a bacterial strain comprising a genome having at least 95.0% ANI to the reference genome of SEQ ID NO: 21, a bacterial strain comprising a genome having at least 95.0% ANI to the reference genome of SEQ ID NO: 26, a bacterial strain comprising a genome having at least 95.0% ANI to the reference genome of SEQ ID NO: 27, a bacterial strain comprising a genome having at least 95.0% ANI to the reference genome of SEQ ID NO: 28, and a bacterial strain comprising a genome having at least 95.0% ANI to the reference genome of SEQ ID NO: 29. In some embodiments, substantially all bacterial strains comprised in the combination collectively comprise genomes having an ANI of at least 95.0% to SEQ ID NOs: 1, 3, 4, 6, 7, 9, 13, 14, 15, 16, 18, 21, 26, 27, 28, and 29. In some embodiments, all bacterial strains comprised in the combination collectively comprise genomes having an ANI of at least 95.0% to SEQ ID NOs: 1, 3, 4, 6, 7, 9, 13, 14, 15, 16, 18, 21, 26, 27, 28, and 29.

In some embodiments, a combination comprises a bacterial strain comprising a genome having at least 99.5% ANI to the reference genome of SEQ ID NO: 1, a bacterial strain comprising a genome having at least 99.5% ANI to the reference genome of SEQ ID NO: 3, a bacterial strain comprising a genome having at least 99.5% ANI to the reference genome of SEQ ID NO: 4, a bacterial strain comprising a genome having at least 99.5% ANI to the reference genome of SEQ ID NO: 6, a bacterial strain comprising a genome having at least 99.5% ANI to the reference genome of SEQ ID NO: 7, a bacterial strain comprising a genome having at least 99.5% ANI to the reference genome of SEQ ID NO: 9, a bacterial strain comprising a genome having at least 99.5% ANI to the reference genome of SEQ ID NO: 13, a bacterial strain comprising a genome having at least 99.5% ANI to the reference genome of SEQ ID NO: 14, a bacterial strain comprising a genome having at least 99.5% ANI to the reference genome of SEQ ID NO: 15, a bacterial strain comprising a genome having at least 99.5% ANI to the reference genome of SEQ ID NO: 16, a bacterial strain comprising a genome having at least 99.5% ANI to the reference genome of SEQ ID NO: 18, a bacterial strain comprising a genome having at least 99.5% ANI to the reference genome of SEQ ID NO: 21, a bacterial strain comprising a genome having at least 99.5% ANI to the reference genome of SEQ ID NO: 26, a bacterial strain comprising a genome having at least 99.5% ANI to the reference genome of SEQ ID NO: 27, a bacterial strain comprising a genome having at least 99.5% ANI to the reference genome of SEQ ID NO: 28, and a bacterial strain comprising a genome having at least 99.5% ANI to the reference genome of SEQ ID NO: 29. In some embodiments, substantially all bacterial strains comprised in the combination collectively comprise genomes having an ANI of at least 99.5% to SEQ ID NOs: 1, 3, 4, 6, 7, 9, 13, 14, 15, 16, 18, 21, 26, 27, 28, and 29. In some embodiments, all bacterial strains comprised in the combination collectively comprise genomes having an ANI of at least 99.5% to SEQ ID NOs: 1, 3, 4, 6, 7, 9, 13, 14, 15, 16, 18, 21, 26, 27, 28, and 29.

In some embodiments, a combination comprises a bacterial strain comprising a genome having at least 99.99% ANI and an AF of at least 99.0% to the reference genome of SEQ ID NO: 1, a bacterial strain comprising a genome having at least 99.99% ANI and an AF of at least 99.0% to the reference genome of SEQ ID NO: 3, a bacterial strain comprising a genome having at least 99.99% ANI and an AF of at least 99.0% to the reference genome of SEQ ID NO: 4, a bacterial strain comprising a genome having at least 99.99% ANI and an AF of at least 99.0% to the reference genome of SEQ ID NO: 6, a bacterial strain comprising a genome having at least 99.99% ANI and an AF of at least 99.0% to the reference genome of SEQ ID NO: 7, a bacterial strain comprising a genome having at least 99.99% ANI and an AF of at least 99.0% to the reference genome of SEQ ID NO: 9, a bacterial strain comprising a genome having at least 99.99% ANI and an AF of at least 99.0% to the reference genome of SEQ ID NO: 13, a bacterial strain comprising a genome having at least 99.99% ANI and an AF of at least 99.0% to the reference genome of SEQ ID NO: 14, a bacterial strain comprising a genome having at least 99.99% ANI and an AF of at least 99.0% to the reference genome of SEQ ID NO: 15, a bacterial strain comprising a genome having at least 99.99% ANI and an AF of at least 99.0% to the reference genome of SEQ ID NO: 16, a bacterial strain comprising a genome having at least 99.99% ANI and an AF of at least 99.0% to the reference genome of SEQ ID NO: 18, a bacterial strain comprising a genome having at least 99.99% ANI and an AF of at least 99.0% to the reference genome of SEQ ID NO: 21, a bacterial strain comprising a genome having at least 99.99% ANI and an AF of at least 99.0% to the reference genome of SEQ ID NO: 26, a bacterial strain comprising a genome having at least 99.99% ANI and an AF of at least 99.0% to the reference genome of SEQ ID NO: 27, a bacterial strain comprising a genome having at least 99.99% ANI and an AF of at least 99.0% to the reference genome of SEQ ID NO: 28, and a bacterial strain comprising a genome having at least 99.99% ANI and an AF of at least 99.0% to the reference genome of SEQ ID NO: 29. In some embodiments, substantially all bacterial strains comprised in the combination collectively comprise genomes having an ANI of at least 99.99% and an AF of at least 99.0% to SEQ ID NOs: 1, 3, 4, 6, 7, 9, 13, 14, 15, 16, 18, 21, 26, 27, 28, and 29. In some embodiments, all bacterial strains comprised in the combination collectively comprise genomes having an ANI of at least 99.99% and an AF of at least 99.0% to SEQ ID NOs: 1, 3, 4, 6, 7, 9, 13, 14, 15, 16, 18, 21, 26, 27, 28, and 29.

In some embodiments, the combination comprises a bacterial strain comprising a genome having at least a minimum ANI to the Reference genome of SEQ ID NO: 1. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 1. In some embodiments, in the set of bacterial strains comprising a genome having at least the minimum ANI to the Reference genome of SEQ ID NO: 1, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 1, the genome of each bacterial strain in the set has at least a minimum Alignment Fraction to the Reference genome of SEQ ID NO: 1. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 3. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 3. In some embodiments, in the set of bacterial strains comprising a genome having at least the minimum ANI to the Reference genome of SEQ ID NO: 3, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 3, the genome of each bacterial strain in the set has at least a minimum Alignment Fraction to the Reference genome of SEQ ID NO: 3. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 4. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 4. In some embodiments, in the set of bacterial strains comprising a genome having at least the minimum ANI to the Reference genome of SEQ ID NO: 4, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 4, the genome of each bacterial strain in the set has at least a minimum Alignment Fraction to the Reference genome of SEQ ID NO: 4. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 6. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 6. In some embodiments, in the set of bacterial strains comprising a genome having at least the minimum ANI to the Reference genome of SEQ ID NO: 6, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 6, the genome of each bacterial strain in the set has at least a minimum Alignment Fraction to the Reference genome of SEQ ID NO: 6. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 7. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 7. In some embodiments, in the set of bacterial strains comprising a genome having at least the minimum ANI to the Reference genome of SEQ ID NO: 7, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 7, the genome of each bacterial strain in the set has at least a minimum Alignment Fraction to the Reference genome of SEQ ID NO: 7. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 9. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 9. In some embodiments, in the set of bacterial strains comprising a genome having at least the minimum ANI to the Reference genome of SEQ ID NO: 9, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 9, the genome of each bacterial strain in the set has at least a minimum Alignment Fraction to the Reference genome of SEQ ID NO: 9. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 13. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 13. In some embodiments, in the set of bacterial strains comprising a genome having at least the minimum ANI to the Reference genome of SEQ ID NO: 13, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 13, the genome of each bacterial strain in the set has at least a minimum Alignment Fraction to the Reference genome of SEQ ID NO: 13. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 14. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 14. In some embodiments, in the set of bacterial strains comprising a genome having at least the minimum ANI to the Reference genome of SEQ ID NO: 14, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 14, the genome of each bacterial strain in the set has at least a minimum Alignment Fraction to the Reference genome of SEQ ID NO: 14. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 15. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 15. In some embodiments, in the set of bacterial strains comprising a genome having at least the minimum ANI to the Reference genome of SEQ ID NO: 15, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 15, the genome of each bacterial strain in the set has at least a minimum Alignment Fraction to the Reference genome of SEQ ID NO: 15. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 16. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 16. In some embodiments, in the set of bacterial strains comprising a genome having at least the minimum ANI to the Reference genome of SEQ ID NO: 16, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 16, the genome of each bacterial strain in the set has at least a minimum Alignment Fraction to the Reference genome of SEQ ID NO: 16. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 18. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 18. In some embodiments, in the set of bacterial strains comprising a genome having at least the minimum ANI to the Reference genome of SEQ ID NO: 18, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 18, the genome of each bacterial strain in the set has at least a minimum Alignment Fraction to the Reference genome of SEQ ID NO: 18. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 21. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 21. In some embodiments, in the set of bacterial strains comprising a genome having at least the minimum ANI to the Reference genome of SEQ ID NO: 21, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 21, the genome of each bacterial strain in the set has at least a minimum Alignment Fraction to the Reference genome of SEQ ID NO: 21. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 26. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 26. In some embodiments, in the set of bacterial strains comprising a genome having at least the minimum ANI to the Reference genome of SEQ ID NO: 26, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 26, the genome of each bacterial strain in the set has at least a minimum Alignment Fraction to the Reference genome of SEQ ID NO: 26. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 27. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 27. In some embodiments, in the set of bacterial strains comprising a genome having at least the minimum ANI to the Reference genome of SEQ ID NO: 27, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 27, the genome of each bacterial strain in the set has at least a minimum Alignment Fraction to the Reference genome of SEQ ID NO: 27. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 28. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 28. In some embodiments, in the set of bacterial strains comprising a genome having at least the minimum ANI to the Reference genome of SEQ ID NO: 28, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 28, the genome of each bacterial strain in the set has at least a minimum Alignment Fraction to the Reference genome of SEQ ID NO: 28. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of SEQ ID NO: 29. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of SEQ ID NO: 29. In some embodiments, in the set of bacterial strains comprising a genome having at least the minimum ANI to the Reference genome of SEQ ID NO: 29, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of SEQ ID NO: 29, the genome of each bacterial strain in the set has at least a minimum Alignment Fraction to the Reference genome of SEQ ID NO: 29. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, a combination comprises a bacterial strain comprising a genome having at least 95.0% ANI to the Reference genome of GCA_023008325.1, a bacterial strain comprising a genome having at least 95.0% ANI to the Reference genome of GCA_023008305.1, a bacterial strain comprising a genome having at least 95.0% ANI to the Reference genome of GCA_023008365.1, a bacterial strain comprising a genome having at least 95.0% ANI to the Reference genome of GCA_023015555.1, a bacterial strain comprising a genome having at least 95.0% ANI to the Reference genome of GCA_023008385.1, a bacterial strain comprising a genome having at least 95.0% ANI to the Reference genome of GCA_023008345.1, a bacterial strain comprising a genome having at least 95.0% ANI to the Reference genome of GCA_023008265.1, and a bacterial strain comprising a genome having at least 95.0% ANI to the Reference genome of GCA_023008285.1. In some embodiments, substantially all bacterial strains comprised in the combination collectively comprise genomes having an ANI of at least 95.0% to GCA_023008325.1, GCA_023008305.1, GCA_023008365.1, GCA_023015555.1, GCA_023008385.1, GCA_023008345.1, GCA_023008265.1, and GCA_023008285.1. In some embodiments, all bacterial strains comprised in the combination collectively comprise genomes having an ANI of at least 95.0% to GCA_023008305.1, GCA_023008365.1, GCA_023015555.1, GCA_023008385.1, GCA_023008345.1, GCA_023008265.1, and GCA_023008285.1.

In some embodiments, a combination comprises a bacterial strain comprising a genome having at least 99.5% ANI to the Reference genome of GCA_023008325.1, a bacterial strain comprising a genome having at least 99.5% ANI to the Reference genome of GCA_023008305.1, a bacterial strain comprising a genome having at least 99.5% ANI to the Reference genome of GCA_023008365.1, a bacterial strain comprising a genome having at least 99.5% ANI to the Reference genome of GCA_023015555.1, a bacterial strain comprising a genome having at least 99.5% ANI to the Reference genome of GCA_023008385.1, a bacterial strain comprising a genome having at least 99.5% ANI to the Reference genome of GCA_023008345.1, a bacterial strain comprising a genome having at least 99.5% ANI to the Reference genome of GCA_023008265.1, and a bacterial strain comprising a genome having at least 99.5% ANI to the Reference genome of GCA_023008285.1. In some embodiments, substantially all bacterial strains comprised in the combination collectively comprise genomes having an ANI of at least 99.5% to GCA_023008325.1, GCA_023008305.1, GCA_023008365.1, GCA_023015555.1, GCA_023008385.1, GCA_023008345.1, GCA_023008265.1, and GCA_023008285.1. In some embodiments, all bacterial strains comprised in the combination collectively comprise genomes having an ANI of at least 99.5% to GCA_023008305.1, GCA_023008365.1, GCA_023015555.1, GCA_023008385.1, GCA_023008345.1, GCA_023008265.1, and GCA_023008285.1.

In some embodiments, a combination comprises a bacterial strain comprising a genome having at least 99.99% ANI and an AF of at least 99.0% to the reference genome of GCA_023008305.1, a bacterial strain comprising a genome having at least 99.99% ANI and an AF of at least 99.0% to the reference genome of GCA_023008365.1, a bacterial strain comprising a genome having at least 99.99% ANI and an AF of at least 99.0% to the reference genome of GCA_023015555.1, a bacterial strain comprising a genome having at least 99.99% ANI and an AF of at least 99.0% to the reference genome of GCA_023008385.1, a bacterial strain comprising a genome having at least 99.99% ANI and an AF of at least 99.0% to the reference genome of GCA_023008345.1, a bacterial strain comprising a genome having at least 99.99% ANI and an AF of at least 99.0% to the reference genome of GCA_023008265.1, and a bacterial strain comprising a genome having at least 99.99% ANI and an AF of at least 99.0% to the reference genome of GCA_023008285.1. In some embodiments, substantially all bacterial strains comprised in the combination collectively comprise genomes having an ANI of at least 99.99% and an AF of at least 99.0% to GCA_023008305.1, GCA_023008365.1, GCA_023015555.1, GCA_023008385.1, GCA_023008345.1, GCA_023008265.1, and GCA_023008285.1. In some embodiments, all bacterial strains comprised in the combination collectively comprise genomes having an ANI of at least 99.99% and an AF of at least 99.0% to GCA_023008305.1, GCA_023008365.1, GCA_023015555.1, GCA_023008385.1, GCA_023008345.1, GCA_023008265.1, and GCA_023008285.1.

In some embodiments, the combination comprises a bacterial strain comprising a genome having at least a minimum ANI to the Reference genome of GCA_023008305.1. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of GCA_023008305.1. In some embodiments, in the set of bacterial strains comprising a genome having at least the minimum ANI to the Reference genome of GCA_023008305.1, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of GCA_023008305.1, the genome of each bacterial strain in the set has at least a minimum Alignment Fraction to the Reference genome of GCA_023008305.1. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of GCA_023008365.1. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of GCA_023008365.1. In some embodiments, in the set of bacterial strains comprising a genome having at least the minimum ANI to the Reference genome of GCA_023008365.1, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of GCA_023008365.1, the genome of each bacterial strain in the set has at least a minimum Alignment Fraction to the Reference genome of GCA_023008365.1. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of GCA_023015555.1. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of GCA_023015555.1. In some embodiments, in the set of bacterial strains comprising a genome having at least the minimum ANI to the Reference genome of GCA_023015555.1, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of GCA_023015555.1, the genome of each bacterial strain in the set has at least a minimum Alignment Fraction to the Reference genome of GCA_023015555.1. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of GCA_023008385.1. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of GCA_023008385.1. In some embodiments, in the set of bacterial strains comprising a genome having at least the minimum ANI to the Reference genome of GCA_023008385.1, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of GCA_023008385.1, the genome of each bacterial strain in the set has at least a minimum Alignment Fraction to the Reference genome of GCA_023008385.1. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of GCA_023008345.1. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of GCA_023008345.1. In some embodiments, in the set of bacterial strains comprising a genome having at least the minimum ANI to the Reference genome of GCA_023008345.1, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of GCA_023008345.1, the genome of each bacterial strain in the set has at least a minimum Alignment Fraction to the Reference genome of GCA_023008345.1. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of GCA_023008265.1. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of GCA_023008265.1. In some embodiments, in the set of bacterial strains comprising a genome having at least the minimum ANI to the Reference genome of GCA_023008265.1, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of GCA_023008265.1, the genome of each bacterial strain in the set has at least a minimum Alignment Fraction to the Reference genome of GCA_023008265.1. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

In some embodiments, the combination comprises a bacterial strain comprising a genome having at least a minimum ANI to the Reference genome of GCA_023008285.1. In some embodiments, the combination comprises at least 2, 3, 4, 5, 6, 7, 8, 9, 10, 11, 12, 13, 14, 15, 16, 17, 18, 19, 20, or more bacterial strains that each comprise a genome having a specified minimum ANI to the Reference genome of GCA_023008285.1. In some embodiments, in the set of bacterial strains comprising a genome having at least the minimum ANI to the Reference genome of GCA_023008285.1, the genome of each bacterial strain in the set has at least the minimum ANI to the genome of each other bacterial strain in the set. In some embodiments, the minimum ANI is 95.0%, 98.0%, 99.0%, 99.5%, or 99.99%. In some embodiments, in the set of bacterial strains comprising a genome having at least the minimum ANI to the Reference genome of GCA_023008285.1, the genome of each bacterial strain in the set has at least a minimum Alignment Fraction to the Reference genome of GCA_023008285.1. In some embodiments, the minimum Alignment Fraction is 55%, 60%, 65%, 70%, 75%, 80%, 85%, 90%, 95%, 96%, 97%, 98%, or 99%. In some embodiments, the minimum ANI is 99.99% and the minimum Alignment Fraction is 99.0%.

Bacterial Strains Belonging to Species Clusters

In some embodiments, a combination comprises at least 1, 2, 3, 4, 5, 6, 7, 8, 9, 10, 11, 12, 13, 14, 15, or 16 bacterial strains, each of the at least 1 bacterial strains comprising a genome (i.e., a chromosome with a nucleotide sequence) belonging to a species cluster selected from a list provided in Table 1.

In some embodiments, bacterial strains of a combination collectively comprise genomes belonging to at least 1, 2, 3, 4, 5, 6, 7, 8, 9, 10, 11, 12, 13, 14, 15, or 16 of the species clusters of a list provided in Table 1.

In some embodiments, bacterial strains of a combination collectively comprise at least N=1, 2, 3, 4, 5, 6, 7, 8, 9, 10, 11, 12, 13, 14, 15, or 16 genomes, each of the N genomes belonging to one of N species clusters selected from a list provided in Table 1, and the combination comprises at least N bacterial strains. In some embodiments, N is 16. In some embodiments, N is 8.

In some embodiments, the combination comprises bacterial strains belonging to at least 1, 2, 3, 4, 5, 6, 7, 8, 9, 10, 11, 12, 13, 14, 15, or 16 of the species clusters *Thomasclavelia* sp000508865, *Flavonifractor plautii, Hungatella effluvii, Blautia coccoides, Enterocloster bolteae, Anaerostipes hominis, Anaerotruncus colihominis, Sellimonas intestinalis, Enterocloster asparagiformis, Otoolea symbiosa, Thomasclavelia ramosa, Faecalicatena contorta, Clostridium*_AP sp000509125, *Eisenbergiella porci, Enterocloster* sp000155435, and *Eisenbergiella tayi*. In some embodiments, substantially all bacterial strains comprised in the combination collectively belong to the species clusters Thomasclavelia sp000508865, *Flavonifractor plautii, Hungatella effluvii, Blautia coccoides, Enterocloster bolteae, Anaerostipes hominis, Anaerotruncus colihominis, Sellimonas intestinalis, Enterocloster asparagiformis, Otoolea symbiosa, Thomasclavelia ramosa, Faecalicatena contorta, Clostridium*_AP sp000509125, *Eisenbergiella porci, Enterocloster* sp000155435, and *Eisenbergiella tayi*. In some embodiments, all bacterial strains comprised in the combination collectively belong to species clusters Thomasclavelia sp000508865, *Flavonifractor plautii, Hungatella effluvii, Blautia coccoides, Enterocloster bolteae, Anaerostipes hominis, Anaerotruncus colihominis, Sellimonas intestinalis, Enterocloster asparagiformis, Otoolea symbiosa, Thomasclavelia ramosa, Faecalicatena contorta, Clostridium*_AP sp000509125, *Eisenbergiella porci, Enterocloster* sp000155435, and *Eisenbergiella tayi*.

In some embodiments, the combination comprises bacterial strains belonging to at least 1, 2, 3, 4, 5, 6, 7, or 8 of the species clusters *Enterocloster bolteae, Anaerotruncus colihominis, Sellimonas intestinalis, Otoolea symbiosa, Blautia celeris, Dorea*_A *longicatena, Clostridium*_AQ *innocuum*, and *Flavonifractor plautii*. In some embodiments, substantially all bacterial strains comprised in the combination collectively belong to species clusters *Enterocloster bolteae, Anaerotruncus colihominis, Sellimonas intestinalis, Otoolea symbiosa, Blautia celeris, Dorea*_A *longicatena, Clostridium*_AQ *innocuum*, and *Flavonifractor plautii*. In some embodiments, all bacterial strains comprised in the combination collectively belong to species clusters *Enterocloster bolteae, Anaerotruncus colihominis, Sellimonas intestinalis, Otoolea symbiosa, Blautia celeris, Dorea*_A *longicatena, Clostridium*_AQ *innocuum*, and *Flavonifractor plautii*.

In some embodiments, a combination comprises a bacterial strain belonging to the species cluster of *Thomasclavelia* sp000508865. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Thomasclavelia* sp000508865.

In some embodiments, a combination comprises a bacterial strain belonging to the species cluster of *Flavonifractor plautii*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Flavonifractor plautii*.

In some embodiments, a combination comprises a bacterial strain belonging to the species cluster of *Hungatella effluvii*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Hungatella effluvii*.

In some embodiments, a combination comprises a bacterial strain belonging to the species cluster of *Blautia coccoides*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Blautia coccoides*.

In some embodiments, a combination comprises a bacterial strain belonging to the species cluster of *Enterocloster bolteae*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Enterocloster bolteae*.

In some embodiments, a combination comprises a bacterial strain belonging to the species cluster of *Anaerostipes hominis*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Anaerostipes hominis*.

In some embodiments, a combination comprises a bacterial strain belonging to the species cluster of *Anaerotruncus colihominis*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Anaerotruncus colihominis.*

In some embodiments, a combination comprises a bacterial strain belonging to the species cluster of *Sellimonas intestinalis*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Sellimonas intestinalis.*

In some embodiments, a combination comprises a bacterial strain belonging to the species cluster of *Enterocloster asparagiformis*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Enterocloster asparagiformis.*

In some embodiments, a combination comprises a bacterial strain belonging to the species cluster of *Otoolea symbiosa*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Otoolea symbiosa.*

In some embodiments, a combination comprises a bacterial strain belonging to the species cluster of *Thomasclavelia ramosa*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Thomasclavelia ramosa.*

In some embodiments, a combination comprises a bacterial strain belonging to the species cluster of *Faecalicatena contorta*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Faecalicatena contorta.*

In some embodiments, a combination comprises a bacterial strain belonging to the species cluster of *Clostridium*_AP sp000509125. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Clostridium*_AP sp000509125.

In some embodiments, a combination comprises a bacterial strain belonging to the species cluster of *Eisenbergiella porci*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Eisenbergiella porci.*

In some embodiments, a combination comprises a bacterial strain belonging to the species cluster of *Enterocloster* sp000155435. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Enterocloster* sp000155435.

In some embodiments, a combination comprises a bacterial strain belonging to the species cluster of *Eisenbergiella tayi*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Eisenbergiella tayi.*

In some embodiments, a combination comprises a bacterial strain belonging to the species cluster of *Blautia celeris*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Blautia celeris.*

In some embodiments, a combination comprises a bacterial strain belonging to the species cluster of *Dorea*_A *longicatena*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Dorea*_A *longicatena.*

In some embodiments, a combination comprises a bacterial strain belonging to the species cluster of *Clostridium*_AQ *innocuum*. In some embodiments, the combination comprises at least 2, 3, 4, 5, 6, 7, 8, 9, 10, 11, 12, 13, 14, 15, 16, 17, 18, 19, 20, or more bacterial strains, each belonging to the species cluster of *Clostridium*_AQ *innocuum.*

Bacterial Strains Having 16S rRNA Gene Sequences with Identity to Reference 16S rRNA Gene Sequences In some embodiments, a combination comprises at least 1, 2, 3, 4, 5, 6, 7, 8, 9, 10, 11, 12, 13, 14, 15, or 16 bacterial strains, each of the at least 1 bacterial strains comprising a 16S rRNA gene sequence having at least a minimum % sequence identity (e.g., at least 97.0%, at least 98.6%, at least 98.7%, or at least 99.0%) to one of SEQ ID NOs: 32, 34, 35, 37, 38, 40, 44, 45, 46, 47, 49, 52, 57, 58, 59, and 60.

In some embodiments, bacterial strains of a combination collectively comprise at least N=1, 2, 3, 4, 5, 6, 7, 8, 9, 10, 11, 12, 13, 14, 15, or 16, each of the N 16S rRNA gene sequences having at least a minimum % sequence identity to one of N nucleotide sequences selected independently from SEQ ID NOs: 32, 34, 35, 37, 38, 40, 44, 45, 46, 47, 49, 52, 57, 58, 59, and 60, and the combination comprises at least N bacterial strains. In some embodiments, N is 16.

In some embodiments, a combination comprises at least 1, 2, 3, 4, 5, 6, 7, or 8 bacterial strains, each of the at least 1 bacterial strains comprising a 16S rRNA gene sequence having at least a minimum % sequence identity (e.g., at least 97.0%, at least 98.6%, at least 98.7%, or at least 99.0%) to one of SEQ ID NOs: 111-118.

In some embodiments, bacterial strains of a combination collectively comprise at least N=1, 2, 3, 4, 5, 6, 7, or 8, each of the N 16S rRNA gene sequences having at least a minimum % sequence identity to one of N nucleotide sequences selected independently from SEQ ID NOs: 111-118, and the combination comprises at least N bacterial strains. In some embodiments, N is 8.

In some embodiments, the minimum % sequence identity is 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9%. In some embodiments, the minimum % sequence identity is 97.0%. In some embodiments, the minimum % sequence identity is 98.6%. In some embodiments, the minimum % sequence identity is 98.7%. In some embodiments, the minimum % sequence identity is 99.0%. In some embodiments, the minimum % sequence identity is 100%.

In some embodiments, a combination comprises a bacterial strain comprising a 16S rRNA gene sequence having at least 97.0% sequence identity to SEQ ID NO: 32, a bacterial strain comprising a 16S rRNA gene sequence having at least 97.0% sequence identity to SEQ ID NO: 34, a bacterial strain comprising a 16S rRNA gene sequence having at least 97.0% sequence identity to SEQ ID NO: 35, a bacterial strain comprising a 16S rRNA gene sequence having at least 97.0% sequence identity to SEQ ID NO: 37, a bacterial strain comprising a 16S rRNA gene sequence having at least 97.0% sequence identity to SEQ ID NO: 38, a bacterial strain comprising a 16S rRNA gene sequence having at least 97.0% sequence identity to SEQ ID NO: 40, a bacterial strain comprising a 16S rRNA gene sequence having at least 97.0% sequence identity to SEQ ID NO: 44, a bacterial strain comprising a 16S rRNA gene sequence having at least 97.0% sequence identity to SEQ ID NO: 45, a bacterial strain comprising a 16S rRNA gene sequence having at least 97.0% sequence identity to SEQ ID NO: 46, a bacterial strain comprising a 16S rRNA gene sequence having at least 97.0% sequence identity to SEQ ID NO: 47, a bacterial strain comprising a 16S rRNA gene sequence having at least 97.0% sequence identity to SEQ ID NO: 49, a bacterial strain comprising a 16S rRNA gene sequence having at least 97.0% sequence identity to SEQ ID NO: 52, a bacterial strain comprising a 16S rRNA gene sequence having at least 97.0% sequence identity to SEQ ID NO: 57, a bacterial strain comprising a 16S rRNA gene sequence having at least 97.0% sequence identity to SEQ ID NO: 58, a bacterial strain comprising a 16S rRNA gene sequence having at least 97.0% sequence identity to SEQ ID NO: 59, and a bacterial strain comprising a 16S rRNA gene sequence having at least 97.0% sequence identity to SEQ ID NO: 60. In some embodiments, substantially all bacterial strains comprised in the combination collectively comprise 16S rRNA gene sequences having at least 97.0% sequence identity to SEQ ID NOs: 32, 34, 35, 37, 38, 40, 44, 45, 46, 47, 49, 52, 57, 58, 59, and 60. In some embodiments, all bacterial strains comprised in the combination collectively comprise 16S rRNA gene sequences having at least 97.0% sequence identity to SEQ ID NOs: 32, 34, 35, 37, 38, 40, 44, 45, 46, 47, 49, 52, 57, 58, 59, and 60.

In some embodiments, a combination comprises a bacterial strain comprising a 16S rRNA gene sequence having at least 98.6% sequence identity to SEQ ID NO: 32, a bacterial strain comprising a 16S rRNA gene sequence having at least 98.6% sequence identity to SEQ ID NO: 34, a bacterial strain comprising a 16S rRNA gene sequence having at least 98.6% sequence identity to SEQ ID NO: 35, a bacterial strain comprising a 16S rRNA gene sequence having at least 98.6% sequence identity to SEQ ID NO: 37, a bacterial strain comprising a 16S rRNA gene sequence having at least 98.6% sequence identity to SEQ ID NO: 38, a bacterial strain comprising a 16S rRNA gene sequence having at least 98.6% sequence identity to SEQ ID NO: 40, a bacterial strain comprising a 16S rRNA gene sequence having at least 98.6% sequence identity to SEQ ID NO: 44, a bacterial strain comprising a 16S rRNA gene sequence having at least 98.6% sequence identity to SEQ ID NO: 45, a bacterial strain comprising a 16S rRNA gene sequence having at least 98.6% sequence identity to SEQ ID NO: 46, a bacterial strain comprising a 16S rRNA gene sequence having at least 98.6% sequence identity to SEQ ID NO: 47, a bacterial strain comprising a 16S rRNA gene sequence having at least 98.6% sequence identity to SEQ ID NO: 49, a bacterial strain comprising a 16S rRNA gene sequence having at least 98.6% sequence identity to SEQ ID NO: 52, a bacterial strain comprising a 16S rRNA gene sequence having at least 98.6% sequence identity to SEQ ID NO: 57, a bacterial strain comprising a 16S rRNA gene sequence having at least 98.6% sequence identity to SEQ ID NO: 58, a bacterial strain comprising a 16S rRNA gene sequence having at least 98.6% sequence identity to SEQ ID NO: 59, and a bacterial strain comprising a 16S rRNA gene sequence having at least 98.6% sequence identity to SEQ ID NO: 60. In some embodiments, substantially all bacterial strains comprised in the combination collectively comprise 16S rRNA gene sequences having at least 98.6% sequence identity to SEQ ID NOs: 32, 34, 35, 37, 38, 40, 44, 45, 46, 47, 49, 52, 57, 58, 59, and 60. In some embodiments, all bacterial strains comprised in the combination collectively comprise 16S rRNA gene sequences having at least 98.6% sequence identity to SEQ ID NOs: 32, 34, 35, 37, 38, 40, 44, 45, 46, 47, 49, 52, 57, 58, 59, and 60.

In some embodiments, a combination comprises a bacterial strain comprising a 16S rRNA gene sequence having at least 98.7% sequence identity to SEQ ID NO: 32, a bacterial strain comprising a 16S rRNA gene sequence having at least 98.7% sequence identity to SEQ ID NO: 34, a bacterial strain comprising a 16S rRNA gene sequence having at least 98.7% sequence identity to SEQ ID NO: 35, a bacterial strain comprising a 16S rRNA gene sequence having at least 98.7% sequence identity to SEQ ID NO: 37, a bacterial strain comprising a 16S rRNA gene sequence having at least 98.7% sequence identity to SEQ ID NO: 38, a bacterial strain comprising a 16S rRNA gene sequence having at least 98.7% sequence identity to SEQ ID NO: 40, a bacterial strain comprising a 16S rRNA gene sequence having at least 98.7% sequence identity to SEQ ID NO: 44, a bacterial strain comprising a 16S rRNA gene sequence having at least 98.7% sequence identity to SEQ ID NO: 45, a bacterial strain comprising a 16S rRNA gene sequence having at least 98.7% sequence identity to SEQ ID NO: 46, a bacterial strain comprising a 16S rRNA gene sequence having at least 98.7% sequence identity to SEQ ID NO: 47, a bacterial strain comprising a 16S rRNA gene sequence having at least 98.7% sequence identity to SEQ ID NO: 49, a bacterial strain comprising a 16S rRNA gene sequence having at least 98.7% sequence identity to SEQ ID NO: 52, a bacterial strain comprising a 16S rRNA gene sequence having at least 98.7% sequence identity to SEQ ID NO: 57, a bacterial strain comprising a 16S rRNA gene sequence having at least 98.7% sequence identity to SEQ ID NO: 58, a bacterial strain comprising a 16S rRNA gene sequence having at least 98.7% sequence identity to SEQ ID NO: 59, and a bacterial strain comprising a 16S rRNA gene sequence having at least 98.7% sequence identity to SEQ ID NO: 60. In some embodiments, substantially all bacterial strains comprised in the combination collectively comprise 16S rRNA gene sequences having at least 98.7% sequence identity to SEQ ID NOs: 32, 34, 35, 37, 38, 40, 44, 45, 46, 47, 49, 52, 57, 58, 59, and 60. In some embodiments, all bacterial strains comprised in the combination collectively comprise 16S rRNA gene sequences having at least 98.7% sequence identity to SEQ ID NOs: 32, 34, 35, 37, 38, 40, 44, 45, 46, 47, 49, 52, 57, 58, 59, and 60.

In some embodiments, a combination comprises a bacterial strain comprising a 16S rRNA gene sequence having at least 99.0% sequence identity to SEQ ID NO: 32, a bacterial strain comprising a 16S rRNA gene sequence having at least 99.0% sequence identity to SEQ ID NO: 34, a bacterial strain comprising a 16S rRNA gene sequence having at least 99.0% sequence identity to SEQ ID NO: 35, a bacterial strain comprising a 16S rRNA gene sequence having at least 99.0% sequence identity to SEQ ID NO: 37, a bacterial strain comprising a 16S rRNA gene sequence having at least 99.0% sequence identity to SEQ ID NO: 38, a bacterial strain comprising a 16S rRNA gene sequence having at least 99.0% sequence identity to SEQ ID NO: 40, a bacterial strain comprising a 16S rRNA gene sequence having at least 99.0% sequence identity to SEQ ID NO: 44, a bacterial strain comprising a 16S rRNA gene sequence having at least 99.0% sequence identity to SEQ ID NO: 45, a bacterial strain comprising a 16S rRNA gene sequence having at least 99.0% sequence identity to SEQ ID NO: 46, a bacterial strain comprising a 16S rRNA gene sequence having at least 99.0% sequence identity to SEQ ID NO: 47, a bacterial strain comprising a 16S rRNA gene sequence having at least 99.0% sequence identity to SEQ ID NO: 49, a bacterial strain comprising a 16S rRNA gene sequence having at least 99.0% sequence identity to SEQ ID NO: 52, a bacterial strain comprising a 16S rRNA gene sequence having at least 99.0% sequence identity to SEQ ID NO: 57, a bacterial strain comprising a 16S rRNA gene sequence having at least 99.0% sequence identity to SEQ ID NO: 58, a bacterial strain comprising a 16S rRNA gene sequence having at least 99.0% sequence identity to SEQ ID NO: 59, and a bacterial strain comprising a 16S rRNA gene sequence having at least 99.0% sequence identity to SEQ ID NO: 60. In some embodiments, substantially all bacterial strains comprised in the combination collectively comprise 16S rRNA gene sequences having at least 99.0% sequence identity to SEQ ID NOs: 32, 34, 35, 37, 38, 40, 44, 45, 46, 47, 49, 52, 57, 58, 59, and 60. In some embodiments, all bacterial strains comprised in the combination collectively comprise 16S rRNA gene sequences having at least 99.0% sequence identity to SEQ ID NOs: 32, 34, 35, 37, 38, 40, 44, 45, 46, 47, 49, 52, 57, 58, 59, and 60.

In some embodiments, the combination comprises a bacterial strain comprising a 16S rRNA gene sequence having at least a minimum % sequence identity to SEQ ID NO: 32. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 32. In some embodiments, in the set of bacterial strains comprising a 16S rRNA gene sequence having at least the minimum % sequence identity to SEQ ID NO: 32, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 34. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 34. In some embodiments, in the set of bacterial strains comprising a 16S rRNA gene sequence having at least the minimum % sequence identity to SEQ ID NO: 34, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 35. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 35. In some embodiments, in the set of bacterial strains comprising a 16S rRNA gene sequence having at least the minimum % sequence identity to SEQ ID NO: 35, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 37. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 37. In some embodiments, in the set of bacterial strains comprising a 16S rRNA gene sequence having at least the minimum % sequence identity to SEQ ID NO: 37, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 38. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 38. In some embodiments, in the set of bacterial strains comprising a 16S rRNA gene sequence having at least the minimum % sequence identity to SEQ ID NO: 38, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 40. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 40. In some embodiments, in the set of bacterial strains comprising a 16S rRNA gene sequence having at least the minimum % sequence identity to SEQ ID NO: 40, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 44. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 44. In some embodiments, in the set of bacterial strains comprising a 16S rRNA gene sequence having at least the minimum % sequence identity to SEQ ID NO: 44, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 45. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 45. In some embodiments, in the set of bacterial strains comprising a 16S rRNA gene sequence having at least the minimum % sequence identity to SEQ ID NO: 45, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 46. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 46. In some embodiments, in the set of bacterial strains comprising a 16S rRNA gene sequence having at least the minimum % sequence identity to SEQ ID NO: 46, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 47. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 47. In some embodiments, in the set of bacterial strains comprising a 16S rRNA gene sequence having at least the minimum % sequence identity to SEQ ID NO: 47, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 49. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 49. In some embodiments, in the set of bacterial strains comprising a 16S rRNA gene sequence having at least the minimum % sequence identity to SEQ ID NO: 49, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 52. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 52. In some embodiments, in the set of bacterial strains comprising a 16S rRNA gene sequence having at least the minimum % sequence identity to SEQ ID NO: 52, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 57. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 57. In some embodiments, in the set of bacterial strains comprising a 16S rRNA gene sequence having at least the minimum % sequence identity to SEQ ID NO: 57, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 58. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 58. In some embodiments, in the set of bacterial strains comprising a 16S rRNA gene sequence having at least the minimum % sequence identity to SEQ ID NO: 58, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 59. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 59. In some embodiments, in the set of bacterial strains comprising a 16S rRNA gene sequence having at least the minimum % sequence identity to SEQ ID NO: 59, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 60. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 60. In some embodiments, in the set of bacterial strains comprising a 16S rRNA gene sequence having at least the minimum % sequence identity to SEQ ID NO: 60, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, a combination comprises a bacterial strain comprising a 16S rRNA gene sequence having at least 97.0% sequence identity to SEQ ID NO: 111, a bacterial strain comprising a 16S rRNA gene sequence having at least 97.0% sequence identity to SEQ ID NO: 112, a bacterial strain comprising a 16S rRNA gene sequence having at least 97.0% sequence identity to SEQ ID NO: 113, a bacterial strain comprising a 16S rRNA gene sequence having at least 97.0% sequence identity to SEQ ID NO: 114, a bacterial strain comprising a 16S rRNA gene sequence having at least 97.0% sequence identity to SEQ ID NO: 115, a bacterial strain comprising a 16S rRNA gene sequence having at least 97.0% sequence identity to SEQ ID NO: 116, a bacterial strain comprising a 16S rRNA gene sequence having at least 97.0% sequence identity to SEQ ID NO: 117, and a bacterial strain comprising a 16S rRNA gene sequence having at least 97.0% sequence identity to SEQ ID NO: 118. In some embodiments, substantially all bacterial strains comprised in the combination collectively comprise 16S rRNA gene sequences having at least 97.0% sequence identity to SEQ ID NOs: 111-118. In some embodiments, all bacterial strains comprised in the combination collectively comprise 16S rRNA gene sequences having at least 97.0% sequence identity to SEQ ID NOs: 111-118.

In some embodiments, a combination comprises a bacterial strain comprising a 16S rRNA gene sequence having at least 98.6% sequence identity to SEQ ID NO: 111, a bacterial strain comprising a 16S rRNA gene sequence having at least 98.6% sequence identity to SEQ ID NO: 112, a bacterial strain comprising a 16S rRNA gene sequence having at least 98.6% sequence identity to SEQ ID NO: 113, a bacterial strain comprising a 16S rRNA gene sequence having at least 98.6% sequence identity to SEQ ID NO: 114, a bacterial strain comprising a 16S rRNA gene sequence having at least 98.6% sequence identity to SEQ ID NO: 115, a bacterial strain comprising a 16S rRNA gene sequence having at least 98.6% sequence identity to SEQ ID NO: 116, a bacterial strain comprising a 16S rRNA gene sequence having at least 98.6% sequence identity to SEQ ID NO: 117, and a bacterial strain comprising a 16S rRNA gene sequence having at least 98.6% sequence identity to SEQ ID NO: 118. In some embodiments, substantially all bacterial strains comprised in the combination collectively comprise 16S rRNA gene sequences having at least 98.6% sequence identity to SEQ ID NOs: 111-118. In some embodiments, all bacterial strains comprised in the combination collectively comprise 16S rRNA gene sequences having at least 98.6% sequence identity to SEQ ID NOs: 111-118.

In some embodiments, a combination comprises a bacterial strain comprising a 16S rRNA gene sequence having at least 98.7% sequence identity to SEQ ID NO: 111, a bacterial strain comprising a 16S rRNA gene sequence having at least 98.7% sequence identity to SEQ ID NO: 112, a bacterial strain comprising a 16S rRNA gene sequence having at least 98.7% sequence identity to SEQ ID NO: 113, a bacterial strain comprising a 16S rRNA gene sequence having at least 98.7% sequence identity to SEQ ID NO: 114, a bacterial strain comprising a 16S rRNA gene sequence having at least 98.7% sequence identity to SEQ ID NO: 115, a bacterial strain comprising a 16S rRNA gene sequence having at least 98.7% sequence identity to SEQ ID NO: 116, a bacterial strain comprising a 16S rRNA gene sequence having at least 98.7% sequence identity to SEQ ID NO: 117, and a bacterial strain comprising a 16S rRNA gene sequence having at least 98.7% sequence identity to SEQ ID NO: 118. In some embodiments, substantially all bacterial strains comprised in the combination collectively comprise 16S rRNA gene sequences having at least 98.7% sequence identity to SEQ ID NOs: 111-118. In some embodiments, all bacterial strains comprised in the combination collectively comprise 16S rRNA gene sequences having at least 98.7% sequence identity to SEQ ID NOs: 111-118.

In some embodiments, a combination comprises a bacterial strain comprising a 16S rRNA gene sequence having at least 99.0% sequence identity to SEQ ID NO: 111, a bacterial strain comprising a 16S rRNA gene sequence having at least 99.0% sequence identity to SEQ ID NO: 112, a bacterial strain comprising a 16S rRNA gene sequence having at least 99.0% sequence identity to SEQ ID NO: 113, a bacterial strain comprising a 16S rRNA gene sequence having at least 99.0% sequence identity to SEQ ID NO: 114, a bacterial strain comprising a 16S rRNA gene sequence having at least 99.0% sequence identity to SEQ ID NO: 115, a bacterial strain comprising a 16S rRNA gene sequence having at least 99.0% sequence identity to SEQ ID NO: 116, a bacterial strain comprising a 16S rRNA gene sequence having at least 99.0% sequence identity to SEQ ID NO: 117, and a bacterial strain comprising a 16S rRNA gene sequence having at least 99.0% sequence identity to SEQ ID NO: 118. In some embodiments, substantially all bacterial strains comprised in the combination collectively comprise 16S rRNA gene sequences having at least 99.0% sequence identity to SEQ ID NOs: 111-118. In some embodiments, all bacterial strains comprised in the combination collectively comprise 16S rRNA gene sequences having at least 99.0% sequence identity to SEQ ID NOs: 111-118.

In some embodiments, the combination comprises a bacterial strain comprising a 16S rRNA gene sequence having at least a minimum % sequence identity to SEQ ID NO: 111. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 1. In some embodiments, in the set of bacterial strains comprising a 16S rRNA gene sequence having at least the minimum % sequence identity to SEQ ID NO: 111, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 112. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 112. In some embodiments, in the set of bacterial strains comprising a 16S rRNA gene sequence having at least the minimum % sequence identity to SEQ ID NO: 112, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 113. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 113. In some embodiments, in the set of bacterial strains comprising a 16S rRNA gene sequence having at least the minimum % sequence identity to SEQ ID NO: 113, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 114. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 114. In some embodiments, in the set of bacterial strains comprising a 16S rRNA gene sequence having at least the minimum % sequence identity to SEQ ID NO: 114, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 115. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 115. In some embodiments, in the set of bacterial strains comprising a 16S rRNA gene sequence having at least the minimum % sequence identity to SEQ ID NO: 115, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 116. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 116. In some embodiments, in the set of bacterial strains comprising a 16S rRNA gene sequence having at least the minimum % sequence identity to SEQ ID NO: 116, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 117. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 117. In some embodiments, in the set of bacterial strains comprising a 16S rRNA gene sequence having at least the minimum % sequence identity to SEQ ID NO: 117, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

In some embodiments, the combination comprises a bacterial strain comprising a 16S rRNA gene sequence having at least a minimum % sequence identity to SEQ ID NO: 118. In some embodiments, the combination comprises at least 2, 3, 4, 5, 6, 7, 8, 9, 10, 11, 12, 13, 14, 15, 16, 17, 18, 19, 20, or more bacterial strains that each comprise a 16S rRNA gene sequence having at least a minimum % sequence identity to SEQ ID NO: 118. In some embodiments, in the set of bacterial strains comprising a 16S rRNA gene sequence having at least the minimum % sequence identity to SEQ ID NO: 118, at least one 16S rRNA gene sequence of each bacterial strain in the set has at least the minimum % sequence identity at least one 16S rRNA gene sequence of each other bacterial strain in the set. In some embodiments, the minimum % sequence identity is 97.0%, 98.6%, 98.7%, or 99.0%.

Conjunction of Classifications

ANI to a Reference genome, belonging to a species cluster, and/or 16S rRNA gene sequence identity may be used in conjunction to classify bacterial strains.

In any embodiment, a bacterial strain comprising a 16S rRNA gene sequence with at least 97.0% sequence identity to SEQ ID NO: 32 may comprise a genome having at least 95.0% ANI to SEQ ID NO: 1. In any embodiment, a bacterial strain comprising a 16S rRNA gene sequence with at least 97.0% sequence identity to SEQ ID NO: 32 may belong to the species cluster *Thomasclavelia* sp000508865. In any embodiment, a bacterial strain comprising a genome with at least 95.0% ANI to SEQ ID NO: 1 may belong to the species cluster *Thomasclavelia* sp000508865.

In any embodiment, a bacterial strain comprising a 16S rRNA gene sequence with at least 97.0% sequence identity to SEQ ID NO: 3 may comprise a genome having at least 95.0% ANI to SEQ ID NO: 34. In any embodiment, a bacterial strain comprising a 16S rRNA gene sequence with at least 97.0% sequence identity to SEQ ID NO: 3 may belong to the species cluster *Flavonifractor plautii*. In any embodiment, a bacterial strain comprising a genome with at least 95.0% ANI to SEQ ID NO: 34 may belong to the species cluster *Flavonifractor plautii*.

In any embodiment, a bacterial strain comprising a 16S rRNA gene sequence with at least 97.0% sequence identity to SEQ ID NO: 35 may comprise a genome having at least 95.0% ANI to SEQ ID NO: 4. In any embodiment, a bacterial strain comprising a 16S rRNA gene sequence with at least 97.0% sequence identity to SEQ ID NO: 35 may belong to the species cluster *Hungatella effluvii*. In any embodiment, a bacterial strain comprising a genome with at least 95.0% ANI to SEQ ID NO: 4 may belong to the species cluster *Hungatella effluvii*.

In any embodiment, a bacterial strain comprising a 16S rRNA gene sequence with at least 97.0% sequence identity to SEQ ID NO: 37 may comprise a genome having at least 95.0% ANI to SEQ ID NO: 6. In any embodiment, a bacterial strain comprising a 16S rRNA gene sequence with at least 97.0% sequence identity to SEQ ID NO: 37 may belong to the species cluster *Blautia coccoides*. In any embodiment, a bacterial strain comprising a genome with at least 95.0% ANI to SEQ ID NO: 6 may belong to the species cluster *Blautia coccoides*.

In any embodiment, a bacterial strain comprising a 16S rRNA gene sequence with at least 97.0% sequence identity to SEQ ID NO: 38 may comprise a genome having at least 95.0% ANI to SEQ ID NO: 7. In any embodiment, a bacterial strain comprising a 16S rRNA gene sequence with at least 97.0% sequence identity to SEQ ID NO: 38 may belong to the species cluster *Enterocloster bolteae*. In any embodiment, a bacterial strain comprising a genome with at least 95.0% ANI to SEQ ID NO: 7 may belong to the species cluster *Enterocloster bolteae*.

In any embodiment, a bacterial strain comprising a 16S rRNA gene sequence with at least 97.0% sequence identity to SEQ ID NO: 40 may comprise a genome having at least 95.0% ANI to SEQ ID NO: 9. In any embodiment, a bacterial strain comprising a 16S rRNA gene sequence with at least 97.0% sequence identity to SEQ ID NO: 40 may belong to the species cluster *Anaerostipes hominis*. In any embodiment, a bacterial strain comprising a genome with at least 95.0% ANI to SEQ ID NO: 9 may belong to the species cluster *Anaerostipes hominis*.

In any embodiment, a bacterial strain comprising a 16S rRNA gene sequence with at least 97.0% sequence identity to SEQ ID NO: 44 may comprise a genome having at least 95.0% ANI to SEQ ID NO: 13. In any embodiment, a bacterial strain comprising a 16S rRNA gene sequence with at least 97.0% sequence identity to SEQ ID NO: 44 may belong to the species cluster *Anaerotruncus colihominis*. In any embodiment, a bacterial strain comprising a genome with at least 95.0% ANI to SEQ ID NO: 13 may belong to the species cluster *Anaerotruncus colihominis*.

In any embodiment, a bacterial strain comprising a 16S rRNA gene sequence with at least 97.0% sequence identity to SEQ ID NO: 45 may comprise a genome having at least 95.0% ANI to SEQ ID NO: 14. In any embodiment, a bacterial strain comprising a 16S rRNA gene sequence with at least 97.0% sequence identity to SEQ ID NO: 45 may belong to the species cluster *Sellimonas intestinalis*. In any embodiment, a bacterial strain comprising a genome with at least 95.0% ANI to SEQ ID NO: 14 may belong to the species cluster *Sellimonas intestinalis*.

In any embodiment, a bacterial strain comprising a 16S rRNA gene sequence with at least 97.0% sequence identity to SEQ ID NO: 46 may comprise a genome having at least 95.0% ANI to SEQ ID NO: 15. In any embodiment, a bacterial strain comprising a 16S rRNA gene sequence with at least 97.0% sequence identity to SEQ ID NO: 46 may belong to the species cluster *Enterocloster asparagiformis*. In any embodiment, a bacterial strain comprising a genome with at least 95.0% ANI to SEQ ID NO: 15 may belong to the species cluster *Enterocloster asparagiformis*.

In any embodiment, a bacterial strain comprising a 16S rRNA gene sequence with at least 97.0% sequence identity to SEQ ID NO: 47 may comprise a genome having at least 95.0% ANI to SEQ ID NO: 16. In any embodiment, a bacterial strain comprising a 16S rRNA gene sequence with at least 97.0% sequence identity to SEQ ID NO: 47 may belong to the species cluster *Otoolea symbiosa*. In any embodiment, a bacterial strain comprising a genome with at least 95.0% ANI to SEQ ID NO: 16 may belong to the species cluster *Otoolea symbiosa*.

In any embodiment, a bacterial strain comprising a 16S rRNA gene sequence with at least 97.0% sequence identity to SEQ ID NO: 49 may comprise a genome having at least 95.0% ANI to SEQ ID NO: 18. In any embodiment, a bacterial strain comprising a 16S rRNA gene sequence with at least 97.0% sequence identity to SEQ ID NO: 49 may belong to the species cluster *Thomasclavelia ramosa*. In any embodiment, a bacterial strain comprising a genome with at least 95.0% ANI to SEQ ID NO: 18 may belong to the species cluster *Thomasclavelia ramosa*.

In any embodiment, a bacterial strain comprising a 16S rRNA gene sequence with at least 97.0% sequence identity to SEQ ID NO: 52 may comprise a genome having at least 95.0% ANI to SEQ ID NO: 21. In any embodiment, a bacterial strain comprising a 16S rRNA gene sequence with at least 97.0% sequence identity to SEQ ID NO: 52 may belong to the species cluster *Faecalicatena contorta*. In any embodiment, a bacterial strain comprising a genome with at least 95.0% ANI to SEQ ID NO: 21 may belong to the species cluster *Faecalicatena contorta*.

In any embodiment, a bacterial strain comprising a 16S rRNA gene sequence with at least 97.0% sequence identity to SEQ ID NO: 57 may comprise a genome having at least 95.0% ANI to SEQ ID NO: 26. In any embodiment, a bacterial strain comprising a 16S rRNA gene sequence with at least 97.0% sequence identity to SEQ ID NO: 57 may belong to the species cluster *Clostridium*_AP sp000509125. In any embodiment, a bacterial strain comprising a genome with at least 95.0% ANI to SEQ ID NO: 26 may belong to the species cluster *Clostridium*_AP sp000509125.

In any embodiment, a bacterial strain comprising a 16S rRNA gene sequence with at least 97.0% sequence identity to SEQ ID NO: 58 may comprise a genome having at least 95.0% ANI to SEQ ID NO: 27. In any embodiment, a bacterial strain comprising a 16S rRNA gene sequence with at least 97.0% sequence identity to SEQ ID NO: 58 may belong to the species cluster *Eisenbergiella porci*. In any embodiment, a bacterial strain comprising a genome with at least 95.0% ANI to SEQ ID NO: 27 may belong to the species cluster *Eisenbergiella porci*.

In any embodiment, a bacterial strain comprising a 16S rRNA gene sequence with at least 97.0% sequence identity to SEQ ID NO: 59 may comprise a genome having at least 95.0% ANI to SEQ ID NO: 28. In any embodiment, a bacterial strain comprising a 16S rRNA gene sequence with at least 97.0% sequence identity to SEQ ID NO: 59 may belong to the species cluster *Enterocloster* sp000155435. In any embodiment, a bacterial strain comprising a genome with at least 95.0% ANI to SEQ ID NO: 28 may belong to the species cluster *Enterocloster* sp000155435.

In any embodiment, a bacterial strain comprising a 16S rRNA gene sequence with at least 97.0% sequence identity to SEQ ID NO: 60 may comprise a genome having at least 95.0% ANI to SEQ ID NO: 29. In any embodiment, a bacterial strain comprising a 16S rRNA gene sequence with at least 97.0% sequence identity to SEQ ID NO: 60 may belong to the species cluster *Eisenbergiella tayi*. In any embodiment, a bacterial strain comprising a genome with at least 95.0% ANI to SEQ ID NO: 29 may belong to the species cluster *Eisenbergiella tayi*.

In any embodiment, a bacterial strain comprising a 16S rRNA gene sequence with at least 97.0% sequence identity to SEQ ID NO: 111 may comprise a genome having at least 95.0% ANI to GCA_023008325.1. In any embodiment, a bacterial strain comprising a 16S rRNA gene sequence with at least 97.0% sequence identity to SEQ ID NO: 111 may belong to the species cluster *Enterocloster bolteae*. In any embodiment, a bacterial strain comprising a genome with at least 95.0% ANI to GCA_023008325.1 may belong to the species cluster *Enterocloster bolteae.*

In any embodiment, a bacterial strain comprising a 16S rRNA gene sequence with at least 97.0% sequence identity to SEQ ID NO: 112 may comprise a genome having at least 95.0% ANI to GCA_023008305.1. In any embodiment, a bacterial strain comprising a 16S rRNA gene sequence with at least 97.0% sequence identity to SEQ ID NO: 112 may belong to the species cluster *Anaerotruncus colihominis*. In any embodiment, a bacterial strain comprising a genome with at least 95.0% ANI to GCA_023008305.1 may belong to the species cluster *Anaerotruncus colihominis.*

In any embodiment, a bacterial strain comprising a 16S rRNA gene sequence with at least 97.0% sequence identity to SEQ ID NO: 113 may comprise a genome having at least 95.0% ANI to GCA_023008365.1. In any embodiment, a bacterial strain comprising a 16S rRNA gene sequence with at least 97.0% sequence identity to SEQ ID NO: 113 may belong to the species cluster *Sellimonas intestinalis*. In any embodiment, a bacterial strain comprising a genome with at least 95.0% ANI to GCA_023008365.1 may belong to the species cluster *Sellimonas intestinalis.*

In any embodiment, a bacterial strain comprising a 16S rRNA gene sequence with at least 97.0% sequence identity to SEQ ID NO: 114 may comprise a genome having at least 95.0% ANI to GCA_023015555.1. In any embodiment, a bacterial strain comprising a 16S rRNA gene sequence with at least 97.0% sequence identity to SEQ ID NO: 114 may belong to the species cluster *Otoolea symbiosa*. In any embodiment, a bacterial strain comprising a genome with at least 95.0% ANI to GCA_023015555.1 may belong to the species cluster *Otoolea symbiosa.*

In any embodiment, a bacterial strain comprising a 16S rRNA gene sequence with at least 97.0% sequence identity to SEQ ID NO: 115 may comprise a genome having at least 95.0% ANI to GCA_023008385.1. In any embodiment, a bacterial strain comprising a 16S rRNA gene sequence with at least 97.0% sequence identity to SEQ ID NO: 115 may belong to the species cluster *Blautia celeris*. In any embodiment, a bacterial strain comprising a genome with at least 95.0% ANI to GCA_023008385.1 may belong to the species cluster *Blautia celeris.*

In any embodiment, a bacterial strain comprising a 16S rRNA gene sequence with at least 97.0% sequence identity to SEQ ID NO: 116 may comprise a genome having at least 95.0% ANI to GCA_023008345.1. In any embodiment, a bacterial strain comprising a 16S rRNA gene sequence with at least 97.0% sequence identity to SEQ ID NO: 116 may belong to the species cluster *Dorea*_A *longicatena*. In any embodiment, a bacterial strain comprising a genome with at least 95.0% ANI to GCA_023008345.1 may belong to the species cluster *Dorea*_A *longicatena.*

In any embodiment, a bacterial strain comprising a 16S rRNA gene sequence with at least 97.0% sequence identity to SEQ ID NO: 117 may comprise a genome having at least 95.0% ANI to GCA_023008265.1. In any embodiment, a bacterial strain comprising a 16S rRNA gene sequence with at least 97.0% sequence identity to SEQ ID NO: 117 may belong to the species cluster *Clostridium*_AQ *innocuum*. In any embodiment, a bacterial strain comprising a genome with at least 95.0% ANI to GCA_023008265.1 may belong to the species cluster *Clostridium*_AQ *innocuum.*

In any embodiment, a bacterial strain comprising a 16S rRNA gene sequence with at least 97.0% sequence identity to SEQ ID NO: 118 may comprise a genome having at least 95.0% ANI to GCA_023008285.1. In any embodiment, a bacterial strain comprising a 16S rRNA gene sequence with at least 97.0% sequence identity to SEQ ID NO: 118 may belong to the species cluster *Flavonifractor plautii*. In any embodiment, a bacterial strain comprising a genome with at least 95.0% ANI to GCA_023008285.1 may belong to the species cluster *Flavonifractor plautii.*

Sources of Bacterial Strains

In some embodiments, one or more of the bacterial strains of the combination are human-derived bacteria, meaning the one or more bacterial strains were obtained from or identified from a human or a sample therefrom (e.g., a human donor). In some embodiments, all of the bacterial strains are human-derived bacteria. In some embodiments, the bacterial strains are derived from more than one human donor.

The bacterial strains used in a combination generally are isolated from the microbiome of healthy individuals. In some embodiments, the combination includes strains originating from a single individual. In some embodiments, the combination includes strains originating from multiple individuals. It should be appreciated that the origin of the bacterial strains of the combination is not limited to the human microbiome from a healthy individual. In some embodiments, one or more bacterial strains originate from a human with a microbiome in dysbiosis. In some embodiments, one or more bacterial strains originate from non-human animals or the environment (e.g., soil or surface water). In some embodiments, bacterial strains of a combination originate from multiple sources (e.g., human and non-human animals).

In some embodiments, the combination includes one or more bacterial strains that are commensal with respect to the human intestines (e.g., the human colon). In some embodiments, the combination includes one or more bacterial strains that are mutualistic with respect to the human intestines (e.g., the human colon). Bacterial strains that are commensal or mutualist with respect to the human intestines need not be isolated or purified from a human source, but may originate from other sources, including non-human mammals such as primates and rodents (e.g., mice).

In some embodiments, a combination includes one or more anaerobic bacteria. In some embodiments, a combination includes only anaerobic bacteria. In some embodiments, a combination includes one or more facultative anaerobic bacteria. In some embodiments, a combination includes only facultative anaerobic bacteria. In some embodiments, a combination includes one or more obligate anaerobic bacteria. In some embodiments, a combination includes only obligate anaerobic bacteria.

In some embodiments, one or more of the bacterial strains is a spore-former. In some embodiments, one or more of the bacterial strains are in spore form. In some embodiments, one or more of the bacterial strains is a non-spore former.

In some embodiments, a combination comprises one or more spore-forming bacterial strains. In some embodiments, a combination comprises one or more non-spore-forming bacterial strains. In some embodiments, a combination comprises both spore-forming and non-spore forming bacterial strains. In some embodiments, one or more spore-forming bacterial strains are in spore form. Spore-forming bacteria can be in spore form (i.e., as spores) or in vegetative form (i.e., as vegetative cells). In spore form, bacteria are generally more resistant to environmental conditions, such as heat, acid, radiation, oxygen, chemicals, and antibiotics. In contrast, in the vegetative state or actively growing state, bacteria are more susceptible to such environmental conditions, compared to in the spore form. In general, bacterial spores are able to germinate from the spore form into a vegetative or actively growing state, under appropriate conditions. For instance, bacteria in spore format may germinate when they are introduced into the intestine.

In some embodiments, at least one (e.g., 1, 2, 3, 4, 5, 6, 7, 8, 9, 10, 11, 12, 13, 14, 15, or 16) of the bacterial strains in a combination is a spore former. In some embodiments, at least one (e.g., 1, 2, 3, 4, 5, 6, 7, 8, 9, 10, 11, 12, 13, 14, 15, or 16) of the bacterial strains in the combination is in spore form. In some embodiments, at least one (e.g., 1, 2, 3, 4, 5, 6, 7, 8, 9, 10, 11, 12, 13, 14, 15, or 16) of the bacterial strains in the combination is a non-spore former. In some embodiments, at least one (e.g., 1, 2, 3, 4, 5, 6, 7, 8, 9, 10, 11, 12, 13, 14, 15, or 16) of the bacterial strains in the combination is in vegetative form (as discussed above, spore-forming bacteria can also be in vegetative form). In some embodiments, at least one (e.g., 1, 2, 3, 4, 5, 6, 7, 8, 9, 10, 11, 12, 13, 14, 15, or 16) of the bacterial strains in the combination is in spore form and at least one (e.g., 1, 2, 3, 4, 5, 6, 7, 8, 9, 10, 11, 12, 13, 14, 15, or 16) of the bacterial strains in the combination is in vegetative form. In some embodiments, at least one bacterial strain that is considered able to form spores (i.e., a spore-former) is present in the combination in vegetative form. In some embodiments, at least one bacterial strain that is considered able to form spores is present in the combination both in spore form and in vegetative form.

It is envisioned that bacterial strains of a combination are alive and will be alive when they reach the target area (e.g., the intestines). Bacterial spores are considered to be alive in this regard. In some embodiments, bacteria that are administered as spores may germinate in the target area (e.g., the intestines). It should further be appreciated that not all of the bacteria are alive, and the combinations can include a percentage (e.g., by weight) that are not alive. In addition, in some embodiments, the combinations include bacterial strains that are not alive when administered or at the time when the composition reaches the target area (e.g., the intestines). It is envisioned that non-living bacteria may still be useful by providing some nutrients and metabolites for the other bacterial strains in the combination.

In any embodiment of a combination, the bacterial strains may be purified. In any embodiment of a combination, the bacterial strains may be isolated. Any of the bacterial strains may be isolated and/or purified, for example, from a source such as a culture or a microbiota sample (e.g., fecal matter). As used herein, an "isolated" bacterial strain refers to a bacterial strain that has been separated from a mixed bacterial population. Any suitable method may be used to isolate bacterial strains, e.g., streaking to isolate colonies and growth in pure culture. The skilled artisan will appreciate that isolated bacterial strains may be combined to prepare a combination that is substantially free of contaminating bacterial strains. As used herein, a "purified" bacterial strain refers to a bacterial strain that is separated from one or more undesired components, such as growth medium or matter from a donor sample (e.g., fecal matter). In some embodiments, a purified bacterial free is substantially free of contaminants of human origin.

Preparation of Bacterial Strains and Combinations

In some embodiments, one or more bacterial strains of a combination are lyophilized or spray-dried. In some embodiments, one or more bacterial strains are lyophilized. In some embodiments, one or more bacterial strains are spray-dried. In some embodiments, each bacterial strain of a combination is lyophilized or spray-dried. In some embodiments, each bacterial strain is lyophilized. In some embodiments, each bacterial strain is spray-dried.

Lyophilization is a freeze-drying process, which typically includes the steps of (i) freezing a liquid, (ii) primary drying to remove water by sublimation, and (iii) secondary drying to remove remaining water by evaporation. Any suitable lyophilization method may be used to lyophilize a combination of bacteria. See, e.g., U.S. Pat. Nos. 3,261,761 and 4,205,132; and PCT Publication Nos. WO 2014/029578 and WO 2012/098358. Bacterial strains may be combined with other components, such as an excipient, prior to spray-drying, or the other components may be added to a spray-dried preparation of bacteria.

Spray drying is a process of forming a dry powder from a liquid by rapidly drying with a hot gas. See, e.g., Ledet et al., Spray-Drying of Pharmaceuticals in "*Lyophilized Biologics and Vaccines*" pages 273-194, Springer. Bacterial strains may be combined with other components, such as an excipient, prior to spray-drying, or the other components may be added to a spray-dried preparation of bacteria.

The skilled artisan will appreciate that both lyophilization and spray-drying remove substantial amounts of water from a composition, resulting in a dried preparation with substantially less water than occurs in naturally occurring bacteria.

Bacterial strains may be grown using any suitable fermentation method. In some embodiments, bacteria are propagated in one or more anaerobic fermenters. Anaerobic fermenters may be, e.g., continuous stirred tank reactors or disposable wave bioreactors. Bacteria in culture medium may be concentrated using any suitable method, examples of which include centrifugation and filtration.

Bacterial Classifications

Bacterial strains of a combination may be classified using one more classification schemes alone or in combination. Bacterial strains may be described, for example, as (i) comprising a genome having at least a minimum average nucleotide identity (ANI) to a Reference genome; (ii) belonging to a species cluster; and/or (iii) comprising a 16S rRNA gene sequence having at least a minimum percent identity to a Reference 16S rRNA gene sequence. Each of these classification schemes is described in more detail below.

Reference Genomes

Some aspects relate to combinations of two or more bacterial strains, each of the two or more bacterial strains comprising a genome (i.e., a chromosome with a nucleotide sequence) having at least a minimum average nucleotide identity (ANI) (e.g., at least 95.0%, 98.0%, 99.0%, 99.5%, or 99.99%) to a Reference genome listed in Table 1. SEQ ID NOs: 1, 3, 4, 6, 7, 9, 13, 14, 15, 16, 18, 21, 26, 27, 28, and 29 represent sequenced genomes of Strains 1, 3, 4, 6, 7, 9, 13, 14, 15, 16, 18, 21, 26, 27, 28, and 29 of VE202. GCA_023008305.1, GCA_023008365.1, GCA_023015555.1, GCA_023008385.1, GCA_023008345.1, GCA_023008265.1, and GCA_023008285.1 represent sequenced genomes of Strains 1, 2, 3, 4, 5, 6, 7, and 8 of VE303.

ANI refers to the average nucleotide identity of a Query genome (e.g., as present in a bacterial strain recited in a claim) to a Reference genome (e.g., as provided by a SEQ ID NO. or Accession No. referenced herein) when comparing orthologous regions between the two genomes. The skilled artisan will understand that ANI is not a calculation of the percentage of matching nucleotides following global alignment of two full-length chromosome sequences. Rather, two genomes are compared to identify regions that are conserved between them, and the average nucleotide identity of all conserved regions is determined. Konstantinidis & Tiedje, *Proc Natl Acad Sci USA*. 2005. 102(7): 2567-2572.

ANI, as defined herein, is calculated using skani v. 0.2.1 with default parameters. Shaw & Yu, *Nat Methods*. 2023. 20:1661-1665. The skilled artisan will appreciate that at the time of filing the instant specification, this program was used to calculate ANI and Alignment Fraction (AF) values in building the most recent release of GTDB, Release 226 (release date: Apr. 16, 2025).

The skilled artisan will also appreciate that a Query genome must meet the following criteria to be suitable for calculation of ANI to a Reference genome:

(i) CheckM completeness estimate of at least 50%; and (ii) CheckM contamination (redundancy) estimate of less than 10%. See, e.g., Parks et al., *Nat Biotechnol*. 2018. 36:996-1004. Table 2 provides these and other quality statistics of genomes provided in Table 1.

A genome described as having at least a minimum ANI to a Reference genome will be understood to also have an Alignment Fraction to the Reference genome of at least 50% (0.50).

In some embodiments, a genome having a specified ANI to a Reference genome also has a minimum Alignment Fraction to the Reference genome that is higher than 50%. In some embodiments, the minimum Alignment Fraction is 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Species Clusters

Some aspects relate to combinations of two or more bacterial strains, each of the two or more bacterial strains comprising a genome (i.e., a chromosome with a nucleotide sequence) belonging to a species cluster selected from a list provided in Table 1. As used herein, a "species cluster" refers to a group of genomes (and/or a group of bacteria comprising the genomes) defined by a representative genome and an ANI circumscription radius, as described in Parks et al., 2020. *Nat Biotechnol*. 38(9):1079-1086. Names of species clusters referenced herein are to be understood as those of GTDB Release 226 (release date: Apr. 16, 2025), with corresponding ANI circumscription radii provided in Release 226.

In some embodiments, the species clusters are selected from those Accession Nos. provided in the column of Table 1 titled "Species Cluster." The skilled artisan will appreciate that these lists of species cluster names correspond to the Accession Nos. provided in Table 1, and are the names assigned to the referenced genomes in GTDB Release 226 (release date: Apr. 16, 2025).

In the event a species cluster provided in Table 1 is later renamed in a subsequent GTDB release, the species cluster in Table 1 is to be construed as encompassing any bacterial strain with a genome that would be classified in the species cluster when using GTDB Release 226 (release date: Apr. 16, 2025). For example, the species cluster named *Clostridium_Q symbiosum* in GTDB Release 214 (Apr. 28, 2023) was renamed to *Otoolea symbiosa* in GTDB Release 220 (Apr. 24, 2024), following valid publication of the genus Otoolea in December 2023 between the two release dates. See Afrizal et al., *Cell Host Microbe*. 2022. 30(11):1630-1645 (effective publication), and Oren & Goker, *Int J Syst Evol Microbiol*. 2023. 73:6080 (valid publication).

In the event a genome having an Accession No. provided in Table 1 is later assigned to another species cluster in a subsequent GTDB release, the corresponding species cluster name in Table 1 is to be construed as encompassing the species cluster to which the Accession No. is assigned in the subsequent GTDB release. For example, Parks et al. describe the scenario where GCF_004359525.1, then representative of the species cluster named *Macrococcus equipercicus* in GTDB Release 95, was updated and found to be distinct from the previous assembly, with updated assembly GCF_004359525.2 having an ANI of 80.6% relative to previous assembly GCF_004359525.1. Consequently, in GTDB Release 202, updated assembly GCF_004359525.2 remained the representative genome of *Macrococcus equipercicus*, while GCF_004359515.1, formerly classified in *Macrococcus equipercicus* on the basis of 99.99% ANI to GCF_004359525.1, was made the representative genome of the species cluster named *Macrococcus carouselicus*. Parks et al., Nucleic Acids Res. 2022. 50(D1): D785-D794. In contrast to the preceding paragraph, where all members of *Clostridium_Q symbiosum* in GTDB Release 214 were assigned to *Otoolea symbiosum* in GTDB Release 220, this example relates to a specific genome being reassigned to a new or different species cluster, while the previously assigned species cluster is still present in the subsequent release.

In evaluating whether a Query bacterium's genome (e.g., as recited in a claim) belongs to a particular species cluster (e.g., as listed in Table 1), the skilled artisan may use the Genome Taxonomy Database Toolkit (GTDB-Tk) to assign the Query bacterium's genome to a species cluster. See, e.g., Chaumeil et al., *Bioinformatics*. 2019. 36(6):1925-1927; Chaumeil et al., *Bioinformatics*. 2022. 38(23):5315-5316, which are incorporated by reference herein to the extent they describe assignment of genomes to GTDB species clusters. For example, the genome having Accession No. GCA_023008365.1 is assigned to the species cluster *Sellimonas intestinalis* on the basis of similarity to the representative genome having Accession No. GCA_001280875.1. Because GTDB-Tk also identifies a Query genome as belonging to a particular genus, the skilled artisan may also compare the Query genome to each genome assigned to the genus, to determine the closest intragenus genome to the Query genome, and the corresponding species cluster of the closest intragenus genome.

The skilled artisan will also appreciate that a Query genome must meet the following criteria to be suitable for assignment to a species cluster:

(i) CheckM completeness estimate >50%;

(ii) CheckM contamination estimate <10%;

(iii) quality score, defined as Completeness—5*Contamination, >50;

(iv) contain >40% of the bac120 or ar53 marker genes;

(v) contain <1000 contigs;

(vi) have an N50 >5 kb; and (vii) contain <100,000 ambiguous bases.

Table 2 provides genome quality statistics of genomes provided in Table 1.

Where a species cluster includes a genome of a type strain of a species that is validly published under the International Code of Nomenclature of Prokaryotes (ICNP), the skilled artisan may also identify a bacterium as belonging to the validly published species by comparing the characteristics of the bacterium to the published description of that species. For example, the description of *Sellimonas intestinalis* is set forth in the valid publication of Seo et al., *Int J Syst Evol Microbiol*. 2016. 66(2):951-956, which describes phenotypic characteristics that differentiate the type strain BR72$^T$ of species *Sellimonas intestinalis* from bacteria of other genera and species in the family Lachnospiraceae. If the bacterium's properties are consistent with the published description of the species, the skilled artisan can reasonably conclude that the bacterium's genome belongs to the species cluster corresponding to the validly published species.

Reference 16S rRNA Gene Sequences

Some aspects relate to combinations of two or more bacterial strains, each of the two or more bacterial strains comprising a 16S rRNA gene sequence having at least a minimum percent sequence identity (e.g., at least 97.0%, 98.6%, 98.7%, or 99.0%) to a Reference 16S rRNA gene sequence provided in Table 1 (i.e., SEQ ID NOs: 32, 34, 35, 37, 38, 40, 44, 45, 46, 47, 49, 52, 57, 58, 59, and 60). SEQ ID NOs: 32, 34, 35, 37, 38, 40, 44, 45, 46, 47, 49, 52, 57, 58, 59, and 60 represent 16S rRNA gene sequences of Strains 1, 3, 4, 6, 7, 9, 13, 14, 15, 16, 18, 21, 26, 27, 28, and 29 of VE202. SEQ ID NOs: 111-118 represent 16S rRNA gene sequences of Strains 1, 2, 3, 4, 5, 6, 7, and 8 of VE303.

In comparing two 16S rRNA gene sequences, the percent sequence identity that a Query sequence (e.g., as present in a bacterial strain recited in a claim) has to a Reference sequence (e.g., having a SEQ ID NO. provided herein) is calculated by (i) aligning the Query sequence to the Reference sequence, (ii) determining the number of matching nucleotides between the aligned Query and Reference sequences, and (iii) dividing the number of matching residues by the length of the Reference sequence, including any gaps introduced into the Reference sequence when the two sequences are aligned.

Where a pairwise alignment between two 16S rRNA gene sequences is contemplated, the first sequence (e.g., Query sequence) is aligned to the second sequence (e.g., Reference sequence) using the Needleman-Wunsch algorithm for global (full-length) alignment of the two sequences. Needleman & Wunsch, *J Mol Biol.* 1970. 48:443-453. Where two nucleotide sequences are aligned, the alignment uses a DNAFULL substitution scoring matrix, a Gap Open penalty of 10, a Gap Extend penalty of 0.5, and no End Gap penalties. The skilled artisan will appreciate that at the time of filing the instant specification, these parameters are the default parameters of the EMBOSS Needle pairwise comparison tool provided by European Bioinformatics Institute (see ebi.ac.uk). Other suitable alignment programs may be used to obtain a global alignment using these parameters, or the Needleman-Wunsch algorithm may be implemented in a scripting language (e.g., Python or R).

In comparing 16S rRNA gene sequences, the skilled artisan will appreciate that to determine whether a Query nucleotide sequence comprises a nucleotide sequence with a given percentage sequence identity to a Reference sequence, the denominator (length of Reference sequence plus internal gaps) in calculating sequence identity need not include gaps shown at the ends of the Reference sequence in an alignment, as such gaps are added where a Query sequence contains additional nucleotides that extend beyond the portions of the Query sequence that align to the 5' end or 3' end of the Reference sequence.

Pharmaceutical Compositions

In some embodiments, a population is formulated as a pharmaceutical composition. As used herein, a "pharmaceutical composition" refers to a product comprising at least one active ingredient, and one or more inactive ingredients, which may include one or more pharmaceutically acceptable excipients.

A pharmaceutical composition may comprise one or more dosage forms. The skilled artisan will appreciate that because members of a population may replicate in a subject and exert a therapeutic effect through their metabolism, gene expression, and/or replication after administration, it is not necessary that all population members administered to the subject be present in a single dosage form (e.g., a single capsule comprising all members of a population).

Members of a population may be included in separate individual dosage forms, in arbitrary combinations in two or more dosage forms, or all population members may be included in a single dosage form. When administered as separate dosage forms, the administration form and route may be the same or different for each dosage form. Dosage forms may be administered simultaneously, sequentially, and/or separately. In some embodiments, simultaneous administration of a plurality of dosage forms occurs when all dosage forms of the plurality are administered within a period of 1, 2, 3, 4, or 5 minute(s). In some embodiments, sequential administration of a plurality of dosage forms occurs when all dosage forms of the plurality are administered in series. In some embodiments, separate administration of a plurality of dosage forms occurs when no two dosage forms of the plurality are administered within a period of 1, 2, 3, 4, or 5 minute(s).

A pharmaceutical composition may be a combination product. "Combination product," as used herein, has the definition specified in 21 § CFR 3.2(e). At the time of filing the instant specification, "combination product" defined under 21 CFR § 3.2(e) includes: (1) A product comprised of two or more regulated components, i.e., drug/device, biologic/device, drug/biologic, or drug/device/biologic, that are physically, chemically, or otherwise combined or mixed and produced as a single entity; (2) Two or more separate products packaged together in a single package or as a unit and comprised of drug and device products, device and biological products, or biological and drug products; (3) A drug, device, or biological product packaged separately that according to its investigational plan or proposed labeling is intended for use only with an approved individually specified drug, device, or biological product where both are required to achieve the intended use, indication, or effect and where upon approval of the proposed product the labeling of the approved product would need to be changed, e.g., to reflect a change in intended use, dosage form, strength, route of administration, or significant change in dose; or (4) Any investigational drug, device, or biological product packaged separately that according to its proposed labeling is for use only with another individually specified investigational drug, device, or biological product where both are required to achieve the intended use, indication, or effect.

Excipients

A pharmaceutically "acceptable" excipient refers to an excipient that must be compatible with the active ingredient and not deleterious to the subject to which it is administered. In some embodiments, the pharmaceutically acceptable excipient is selected based on the intended route of administration of the composition. For example, a pharmaceutical composition for oral administration may comprise a different pharmaceutically acceptable excipient than a pharmaceutical composition for rectal administration. Examples of excipients include sterile water, physiological saline, solvent, a base material, an emulsifier, a suspending agent, a surfactant, a stabilizer, a flavoring agent, an aromatic, an excipient, a vehicle, a preservative, a binder, a diluent, a tonicity adjusting agent, a soothing agent, a bulking agent, a disintegrating agent, a buffer agent, a coating agent, a lubricant, a colorant, a sweetener, a thickening agent, and a solubilizer.

Pharmaceutical compositions can be prepared in accordance with methods well known and routinely practiced in the art. See, e.g., Remington: The Science and Practice of Pharmacy, Mack Publishing Co. 20th ed. 2000). Pharmaceutical compositions may further comprise any carriers or stabilizers in the form of a lyophilized formulation or an aqueous solution. Acceptable excipients, carriers, or stabilizers may include, for example, buffers, antioxidants, preservatives, polymers, chelating reagents, and/or surfactants. Pharmaceutical compositions are preferably manufactured under GMP conditions. Pharmaceutical compositions can be used orally, rectally, nasally or parenterally, for instance, in the form of capsules, tablets, pills, sachets, liquids, powders, granules, fine granules, film-coated preparations, pellets, troches, sublingual preparations, chewables, buccal preparations, pastes, syrups, suspensions, elixirs, emulsions, liniments, ointments, plasters, cataplasms, transdermal absorption systems, lotions, inhalations, aerosols, injections, suppositories, and the like.

Delivery Forms

In some embodiments, a dosage form (e.g., of a pharmaceutical composition) is formulated for oral or rectal administration. In some embodiments, a dosage form is formulated for oral administration. In some embodiments, a dosage form is formulated for rectal administration.

In some embodiments, a dosage form is formulated for delivery to the intestines of a subject. In some embodiments, a dosage form is formulated for delivery to the colon of a subject. In some embodiments, the subject for formulation is a human subject.

In some embodiments, a dosage form comprises an enteric coating that increases survival of population members during passage through the stomach. The enteric coating will be understood as one which resists the action of gastric juices in the stomach, so that the population in the dosage form will pass through the stomach and into the intestines. The enteric coating may readily dissolve when in contact with intestinal fluids, so that the population enclosed in the coating will be released in the intestinal tract. Enteric coatings may include polymers and copolymers well known in the art, such as commercially available EUDRAGIT® (Evonik Industries). See, e.g., Zhang, *AAPS PharmSciTech* (2016) 17 (1), 56-67.

In some embodiments, a dosage form is formulated for delivery to an intestine (e.g., the large intestine (colon)). In some embodiments, a dosage form comprises a pH-sensitive composition comprising one or more enteric polymers. Such pH-sensitive compositions will be understood as those that allow release of the dosage form's contents (e.g., bacterial strains) after reaching the alkaline environment of the intestines following passage through the acidic environment of the stomach. Preferably, the pH at which contents are released is 6.8 to 7.5, which is the range at which the pH shifts to the alkaline side at a distal portion of the stomach. The skilled artisan will also appreciate that different chemical environments, including pH, exist along different parts of the intestines (e.g., the duodenum, jejunum, ileum, cecum, colon and rectum). Thus, the pH sensitivity of a composition may be varied to target delivery to a specific region of the intestines. See, e.g., Villena et al., *Int J Pharm.* 2015. 487 (1-2):314-319.

In some embodiments, a dosage form is formulated for delayed release of contents (e.g., bacterial strains) by 3 to 5 hours, which corresponds to transit time to the small intestine. Such dosage forms may include any number of suitable coatings, examples of which include in vivo degradable polymers, gradually hydrolyzable polymers, gradually water-soluble polymers, and/or enzyme degradable polymers. Additional examples include cellulose-based polymers such as hydroxypropyl cellulose, acrylic acid polymers and copolymers such as methacrylic acid polymers and copolymers, and vinyl polymers and copolymers such as polyvinylpyrrolidone.

In some embodiments, a dosage form comprises a hydrogel. Hydrogels become hydrated following contact with gastrointestinal fluid, resulting in swelling and release of their contents.

In some embodiments, a dosage form includes a bioadhesive composition that adheres to the colonic mucosal membrane. Examples of bioadhesive polymers are described, e.g., in U.S. Pat. No. 6,368,486, incorporated by reference to the extent it describes bioadhesive polymers.

In some embodiments, a dosage form comprises a protease inhibitor, which protects its contents from the activity of proteases in the gut prior to release of the contents.

In some embodiments, a dosage form comprises a pressure-sensitive composition, which allows release of its contents in response to a pressure change resulting from bacterial fermentation in the intestines or distal portion of the stomach.

In some embodiments, a dosage form comprises a coating that is degradable by an enzyme present in an intestine. Non-limiting examples of such enzymes include carbohydrate hydrolase and carbohydrate hydrolase, and of such coating materials include non-starch polysaccharides, amylose, xanthan gum, and azopolymers.

In some embodiments, a dosage form is administered through an orifice (e.g., nasal tube) or surgery. Mechanical delivery methods and chemical delivery formulations (e.g., pH-sensitive compositions) may be combined.

Dosage forms may be in any suitable form factor. Examples of form factors include tablets, pills, capsules, powders, granules, liquid suspensions, and suppositories. In some embodiments, a dosage form is a capsule.

Also contemplated are dosage forms for routes other than rectal or oral administration, such as topical, parenteral, intramuscular, intranasal, intravenous, and infusion administration. Suitable routes of administration will depend on the type of population to be administered, and their selection is within the level of ordinary skill in the art.

Food Products and Nutritional Supplements

Some aspects relate to food products comprising a population and a nutrient. Some aspects relate to nutritional supplements comprising a population. Food products and nutritional supplements may be those intended for consumption by certain categories of subject.

Food products and nutritional supplements are, in general, intended for consumption by a human or animal. Whereas food products contain substantial caloric content, nutritional supplements are to be understood has having negligible (<10 kcal/serving) caloric content.

Food products and nutritional supplements may be in the form of a solid or semi-solid food, or a liquid beverage. Non-limiting examples of beverage forms include juices, milk, fermented beverages, carbonated beverages, alcoholic beverages, and flavored beverages. Non-limiting examples of food forms include rice, pasta, cereals, bread, pastes (e.g., fish hams, sausages, seafood pastes, bean pastes), curries, ice cream, cheese, yogurt, pickles, jellies, gummies, soup, and caramels.

Food products and nutritional supplements may be produced by any suitable method and contain the same amount or number of population members (e.g., by CFU of bacteria) as a pharmaceutical composition.

TABLE 1

| Bacterial strains of VE202 and VE303 | | | | | |
|---|---|---|---|---|---|
| Strain # | Genome SEQ ID NO. | 16S rRNA gene sequence SEQ ID NO. | Species Cluster (GTDB R226) | Accession No. of Species Cluster Representative Genome (GTDB R226) | Type Strain |
| VE202-01 | 1 | 32 | *Thomasclavelia* sp000508865 | GCA_000508865.1 | |
| VE202-03 | 3 | 34 | *Flavonifractor plautii* | GCF_000239295.1 | DSM 4000 (=ATCC 29863) |
| VE202-04 | 4 | 35 | *Hungatella effluvii* | GCF_003201875.1 | DSM 24995 |
| VE202-06 | 6 | 37 | *Blautia coccoides* | GCF_034355335.1 | DSM 935 (=NCTC11035) |
| VE202-07 | 7 | 38 | *Enterocloster bolteae* | GCF_002234575.2 | DSM 15670 (=ATCC BAA-613) |
| VE202-09 | 9 | 40 | *Anaerostipes hominis* | GCF_002270485.1 | JCM 32275 (=BG01) |
| VE202-13 | 13 | 44 | *Anaerotruncus colihominis* | GCF_025146135.1 | DSM 17241 |
| VE202-14 | 14 | 45 | *Sellimonas intestinalis* | GCF_001280875.1 | JCM 30749 (=BR72) |
| VE202-15 | 15 | 46 | *Enterocloster asparagiformis* | GCF_025149125.1 | DSM 15981 |
| VE202-16 | 16 | 47 | *Otoolea symbiosa* | GCF_000466485.1 | DSM 934 (=ATCC 14940) |
| VE202-18 | 18 | 49 | *Thomasclavelia ramosa* | GCF_014131695.1 | DSM 1402 |
| VE202-21 | 21 | 52 | *Faecalicatena contorta* | GCF_039521745.1 | DSM 3982 (=JCM 6483) |
| VE202-26 | 26 | 57 | *Clostridium*_AP sp000509125 | GCA_019597925.1 | |
| VE202-27 | 27 | 58 | *Eisenbergiella porci* | GCF_009696275.1 | DSM 101007 (=WCA-389-WT-23B) |
| VE202-28 | 28 | 59 | *Enterocloster* sp000155435 | GCA_000155435.1 | |
| VE202-29 | 29 | 60 | *Eisenbergiella tayi* | GCF_001881565.1 | DSM 26961 |
| VE303-01 | GCA_023008325.1 | 111 | *Enterocloster bolteae* | GCF_002234575.2 | DSM 15670 (=ATCC BAA-613) |
| VE303-02 | GCA_023008305.1 | 112 | *Anaerotruncus colihominis* | GCF_025146135.1 | DSM 17241 |
| VE303-03 | GCA_023008365.1 | 113 | *Sellimonas intestinalis* | GCF_001280875.1 | JCM 30749 (=BR72) |
| VE303-04 | GCA_023015555.1 | 114 | *Otoolea symbiosa* | GCF_000466485.1 | DSM 934 (=ATCC 14940) |
| VE303-05 | GCA_023008385.1 | 115 | *Blautia celeris* | GCF_014287615.1 | CGMCC 1.32807 (=NSJ-34) |
| VE303-06 | GCA_023008345.1 | 116 | *Dorea*_A *longicatena* | GCF_025150085.1 | DSM 13814 |
| VE303-07 | GCA_023008265.1 | 117 | *Clostridium*_AQ *innocuum* | GCF_012317185.1 | DSM 1286 (=ATCC 14501) |
| VE303-08 | GCA_023008285.1 | 118 | *Flavonifractor plautii* | GCF_000239295.1 | DSM 4000 (=ATCC 29863) |

TABLE 2

| VE202 strain genome quality statistics*** | | | | | | | | | |
|---|---|---|---|---|---|---|---|---|---|
| Strain # | Genome SEQ ID NO. | CheckM Completeness (%) | CheckM Completeness (%) | CheckM2 Completeness (%) | CheckM2 Contamination (%) | Percentage of bac120 Marker Genes* | Contig # | N50 (Mbp) | Ambiguous Bases** |
| VE202-01 | 1 | 100.00 | 0.00 | 100.0 | 3.05 | 100 | 3 | 3.82 | 0.00 |
| VE202-03 | 3 | 99.33 | 0.81 | 99.99 | 5.14 | 99.2 | 8 | 3.32 | 0.00 |
| VE202-04 | 4 | 99.37 | 1.74 | 97.08 | 9.7 | 100 | 1 | 7.38 | 0.00 |
| VE202-06 | 6 | 98.73 | 0.21 | 100.0 | 4.88 | 99.2 | 1 | 6.16 | 0.00 |
| VE202-07 | 7 | 99.32 | 0.56 | 100.0 | 3.61 | 100 | 1 | 6.07 | 0.00 |
| VE202-09 | 9 | 99.33 | 4.05 | 99.86 | 1.06 | 100 | 1 | 3.52 | 0.00 |

TABLE 2-continued

VE202 strain genome quality statistics***

| Strain # | Genome SEQ ID NO. | CheckM Completeness (%) | CheckM Completeness (%) | CheckM2 Completeness (%) | CheckM2 Contamination (%) | Percentage of bac120 Marker Genes* | Contig # | N50 (Mbp) | Ambiguous Bases** |
|---|---|---|---|---|---|---|---|---|---|
| VE202-13 | 13 | 98.66 | 0.22 | 97.4 | 0.73 | 98.3 | 3 | 3.46 | 0.00 |
| VE202-14 | 14 | 98.83 | 1.07 | 99.08 | 0.26 | 100 | 1 | 3.20 | 0.00 |
| VE202-15 | 15 | 99.22 | 0.63 | 96.21 | 5.17 | 98.3 | 1 | 6.23 | 0.00 |
| VE202-16 | 16 | 99.37 | 0.00 | 98.68 | 3.62 | 100 | 6 | 3.74 | 0.00 |
| VE202-18 | 18 | 100.00 | 0.00 | 100.0 | 3.29 | 94.2 | 5 | 3.29 | 0.00 |
| VE202-21 | 21 | 99.42 | 0.00 | 100.0 | 4.17 | 100 | 1 | 5.42 | 0.00 |
| VE202-26 | 26 | 98.83 | 0.00 | 97.48 | 0.81 | 100 | 1 | 3.94 | 0.00 |
| VE202-27 | 27 | 98.74 | 2.01 | 100.0 | 10.53 | 100 | 9 | 2.42 | 0.00 |
| VE202-28 | 28 | 99.37 | 1.27 | 99.99 | 5.22 | 97.5 | 1 | 6.93 | 0.00 |
| VE202-29 | 29 | 98.85 | 2.01 | 99.85 | 9.78 | 100 | 2 | 7.55 | 0.00 |

* Percentage of bac120 marker genes of GTDB Release 226, calculated as (# total markers − # missing hits)/# total markers.

**# Ns per 100 kbp, per QUAST. See, e.g., Gurevich *et al*., *Bioinformatics*. 2013. 29(8):1072-1075.

***VE303 strain genome quality statistics available from GTDB Release 226.

ENUMERATED EMBODIMENTS

A1. A method of quantifying an abundance of a member in a composition comprising a mixed population of at least two members, the method comprising estimating unadjusted most probable number (MPN) abundances of the member and at least one other member in the mixed population using an MPN assay, and estimating an adjusted MPN abundance of the member by transforming the unadjusted MPN abundance of the member with a predetermined calibration matrix, wherein the MPN assay comprises:

(i) preparing a plurality of serially diluted samples of the mixed population;

(ii) incubating the plurality of serially diluted samples of the mixed population under conditions to allow replication, metabolism, or gene expression of the at least two members;

(iii) identifying presence or absence of the at least two members of the mixed population in the plurality of serially diluted samples of the mixed population; and (iv) determining the unadjusted MPN abundances of the at least two members, wherein the predetermined calibration matrix correlates unadjusted MPN abundances to reference standard abundances of the at least two members in a calibration sample, and wherein the calibration sample comprises the at least two members in predetermined reference standard abundances.

A2. The method of Embodiment A1, wherein the predetermined calibration matrix comprises one or more element accounting for interactions between the at least two members of the mixed population in the incubating of (ii).

A3. The method of any one of Embodiments A1-A2, wherein at least one element is derived from a regression model correlating a predetermined reference standard abundance of the member to unadjusted MPN abundances of the at least two members in the calibration sample.

A4. The method of any one of Embodiments A1-A3, wherein unadjusted MPN abundance of each of the at least two members is calculated with assumption that identifying the presence or absence of a member in step (iii) is independent of the presence or absence of other members in the same serially diluted sample.

A5. The method of any one of Embodiments A1-A4, wherein predetermined reference standard abundances of the at least two members are defined by abundances of the at least two members in separate samples each consisting essentially of a single member, and wherein the calibration sample comprises a combination of the separate samples in a predetermined proportion.

A6. The method of any one of Embodiments A1-A5, wherein for the set of the at least two members of the calibration sample, mean deviation of adjusted MPN abundance from the predetermined reference standard abundance in the calibration sample is less than mean deviation of unadjusted MPN abundance from the predetermined reference standard abundance in the calibration sample.

A7. The method of any one of Embodiments A1-A6, wherein presence of a member is defined by detection of a signal of the member above a detectable threshold, and absence is defined by lack of detection of the signal above the detectable threshold.

A8. The method of any one of Embodiments A1-A7, wherein the method is a method of quality control of a composition, and the method comprises identifying the composition as comprising the at least two members within a defined abundance tolerance.

A9. The method of any one of Embodiments A1-A8, wherein the method further comprises administering the composition to a subject in need thereof.

A10. The method of any one of Embodiments A1-A9, wherein the method further comprises formulating or packaging the composition for administration to a subject in need thereof at a dose of the at least two members within the defined abundance tolerance.

A11. A composition made by the method of any one of Embodiments A1-A10.

A12. A plurality of the composition of Embodiment A11.

B1. A composition comprising a mixed population comprising at least two members at adjusted most probable number (MPN) abundance within a defined abundance tolerance, wherein adjusted MPN abundance of a member is estimated by (1) estimating unadjusted MPN abundance of the member and at least one other member in the mixed population using an MPN assay, and (2) transforming the unadjusted MPN abundance of the member with a predetermined calibration matrix, wherein the MPN assay comprises:

(i) preparing a plurality of serially diluted samples of the mixed population;

(ii) incubating the plurality of serially diluted samples of the mixed population under conditions to allow replication, metabolism, or gene expression of the at least two members;

(iii) identifying presence or absence of the at least two members of the mixed population in the plurality of serially diluted samples of the mixed population; and (iv) determining the unadjusted MPN abundances of the at least two members, wherein the predetermined calibration matrix correlates unadjusted MPN abundances to reference standard abundances of the at least two members in a calibration sample, and wherein the calibration sample comprises the at least two members in predetermined reference standard abundances.

B2. The composition of Embodiment B1, wherein the predetermined calibration matrix comprises one or more elements accounting for interactions between the at least two members of the mixed population in the incubating of (ii).

B3. The composition of any one of Embodiments B1-B2, wherein at least one element is derived from a regression model correlating a predetermined reference standard abundance of a member to unadjusted MPN abundances of the at least two members in the calibration sample.

B4. The composition of any one of Embodiments B1-B3, wherein unadjusted MPN abundance of each of the at least two members is calculated with assumption that identifying the presence or absence of a member in step (iii) is independent of the presence or absence of other members in the same serially diluted sample.

B5. The composition of any one of Embodiments B1-B4, wherein predetermined reference standard abundances of the at least two members are defined by abundances of the at least two members in separate samples each consisting essentially of a single member, and wherein the calibration sample comprises a combination of the separate samples in a predetermined proportion.

B6. The composition of Embodiment any one of Embodiments B1-B5, wherein for the set of the at least two members of the calibration sample, mean deviation of adjusted MPN abundance from the predetermined reference standard abundance in the calibration sample is less than mean deviation of unadjusted MPN abundance from the predetermined reference standard abundance in the calibration sample.

B7. The composition of Embodiment any one of Embodiments B1-B6, wherein presence of a member is defined by detection of a signal of the member above a detectable threshold, and absence is defined by lack of detection of the signal above the detectable threshold.

B8. The composition of Embodiment any one of Embodiments B1-B7, wherein the composition is formulated or packaged for administration to a subject in need thereof at a dose of each of the at least two population members within the defined abundance tolerance.

B9. A plurality of the composition of Embodiment B8.

C0. The composition, method, or plurality of any one of the preceding Embodiments, wherein the plurality of serially diluted samples of step (i) comprises a dilution series bounded by a minimum dilution at the lower end and a maximum dilution at the upper end, wherein at least n independent replicates at each dilution are incubated in step (ii), wherein presence of a population member is defined by detection of a signal of the population member above a detectable threshold, and absence is defined by lack of detection of the signal above the detectable threshold.

C1. The composition, method, or plurality of Embodiment C0, wherein the detectable threshold is a limit of detection.

C2. The composition, method, or plurality of any one of Embodiments C0-C1, wherein:

at the minimum dilution, each of the at least two population members is present in one or more of the n independent replicates; and at the maximum dilution, each of the at least two population members is absent from one or more of the n independent replicates.

C3. The composition, method, or plurality of any one of Embodiments C0-C2, wherein the dilution factor, number of serial dilutions, maximum dilution, and or minimum dilution of the MPN assay are selected to yield:

presence of each of the at least two population members among at least 25% of replicates at the minimum dilution; and absence of each of the at least two population members among at least 25% of replicates at the maximum dilution.

C4. The composition, method, or plurality of any one of Embodiments C0-C3, wherein for at least one population member, a coefficient of variation (CV) of adjusted MPN abundance is not more than a CV of unadjusted MPN abundance.

C5. The composition, method, or plurality of Embodiment C4, wherein for each of the at least two population members, the CV of adjusted MPN abundance is not more than the CV of unadjusted MPN abundance.

C6. The composition, method, or plurality of Embodiment C4 or C5, wherein the CVs are calculated with ln- or $\log_{10}$-transformed abundances.

C7. The plurality of any one of Embodiments A12 or B9, wherein at least one composition of the plurality comprises at least one of the at least two population members at an unadjusted MPN abundance outside the defined abundance tolerance.

C8. The plurality of any one of Embodiments A12 or B9, wherein more compositions of the plurality comprise each of the at least two population members at adjusted MPN abundances within the defined abundance tolerance, compared to the number of compositions that comprise each of the at least two population members at unadjusted MPN abundances within the defined abundance tolerance.

C9. The composition, method, or plurality of any one of Embodiments C0-C8, wherein the calibration matrix comprises regression coefficients of a regression model correlating a plurality of reference standard abundances to a plurality of unadjusted MPN abundances in a plurality of k calibration sample populations.

C10. The composition, method, or plurality of Embodiment C9, wherein:

reference standard abundances of the at least two population members are measured in each of k separate substantially pure populations each consisting essentially of the population member using a reference standard abundance method, and wherein reference standard abundance of each population member in each of the k separate substantially pure populations is measured independently from each other of the k separate substantially pure populations consisting essentially of the population member;

each calibration sample is prepared independently from each other calibration sample; and/or MPN assays for each calibration sample are performed independently from each other calibration sample.

C11. The composition, method, or plurality of Embodiment C9 or C10, wherein the regression coefficients comprise $\beta_{i,j}$ fitting the equation:

$$RSA_{i,k} = \sum_{j=1}^{N} (\beta_{i,j} \times uMPNA_{j,k}).$$

C12. The composition, method, or plurality of Embodiment C9 or C10, wherein the regression coefficients comprise $\beta_i$ and $\beta_{i,j}$ fitting the equation:

$$RSA_{i,k} = [\beta_i \times uMPNA_{i,k}] + \sum_{j=1}^{N} [\beta_{i,j} \times (uMPNA_{i,k} - uMPNA_{j,k})],$$

wherein (uMPNAi,k–uMPNAj,k) is assumed to be 0 when (uMPNAi,k–uMPNAj,k)<0.

C13. The composition, method, or plurality of any one of Embodiments, C9-C12, wherein the dilution series, number of serial dilutions, maximum dilution, and/or minimum dilution of the MPN dilution assay, and the number of calibration sample populations k, are selected to yield a 95% confidence interval of adjusted MPN abundance whose upper bound is:

no more than 100 times its lower bound; and/or no more than 50% of adjusted MPN abundance.

C14. The composition, method, or plurality of any one of Embodiments C9-C13, wherein k is at least 3, 4, 5, 6, 7, 8, 9, 10, 11, 12, 13, 14, 15, 16, 17, 18, 19, or 20.

C15. The composition, method, or plurality of any one of Embodiments C9-C14, wherein the regression coefficients are fit to ln- or $\log_{10}$-transformed abundances.

C16. The composition, method, or plurality of any one of Embodiments C0-C15, wherein the range of serial dilutions comprises at least 3, 4, 5, 6, 7, 8, 9, 10, 11, 12, 13, 14, 15, 16, 17, 18, 19, or 20 dilutions.

C17. The composition, method, or plurality of any one of Embodiments C0-C16, wherein the dilutions of the dilution series are separated by a dilution factor of at least 1:2, 1:3, 1:3.16, 1:4, 1:5, 1:6, 1:7, 1:8, 1:9, or 1:10.

C18. The composition, method, or plurality of any one of Embodiments C0-C17, wherein the maximum dilution is at least 100, 10,000, 100,000, or 1,000,000 times the concentration of the minimum dilution.

D1. The composition, method, or plurality of any one of the preceding Embodiments, wherein the mixed population comprises at least two bacterial strains.

D2. The composition, method, or plurality of Embodiment D1, wherein each bacterial strain i comprises a genome sharing less than 99.99% average nucleotide identity (ANI) or an alignment fraction (AF) of less than 90% with each other bacterial strain j.

D3. The composition, method, or plurality of Embodiment D1 or D2, wherein reference standard abundance of bacterial strains is measured in colony-forming units (CFUs).

D4. The composition, method, or plurality of Embodiment D1 or D2, wherein reference standard abundance of bacterial strains is measured in bacterial genome copy number.

D5. The composition, method, or plurality of any one of Embodiments D1-D4, wherein one or more bacterial strains of the mixed population are strict anaerobes, and wherein reagents used in measuring reference standard abundance and MPN abundance are pre-reduced in an anaerobic environment for a duration sufficient to eliminate negative influence of environmental components on bacterial growth.

D6. The composition, method, or plurality of Embodiment D5, wherein the reagents comprise diluent and culture media.

D7. The composition, method, or plurality of any one of Embodiments D1-D6, wherein the signal of a bacterial strain i is a nucleic acid comprising a nucleotide sequence that is present in that bacterial strain and not in any other bacterial strain j.

D8. The composition, method, or plurality of any one of Embodiments D1-D6, wherein the signal of a bacterial strain i is a metabolite produced by that bacterial strain and not by any other bacterial strain j.

D9. The composition, method, or plurality of any one of Embodiments D1-D6, wherein the signal of a bacterial strain i is a metabolite consumed by that bacterial strain and not by any other bacterial strain j.

D10. The composition, method, or plurality of any one of Embodiments D1-D6, wherein the signal of a bacterial strain i is a cellular morphology distinguishable from each other bacterial strain j.

E1. The composition, method, or plurality of any one of Embodiments A1-C18, wherein the mixed population comprises at least two viruses.

E2. The composition, method, or plurality of Embodiment E1, wherein reference standard abundance of population members is measured in plaque-forming units (PFUs).

E3. The composition, method, or plurality of Embodiment E1, wherein reference standard abundance of population members is measured in viral genome or genome segment copy number.

E4. The composition, method, or plurality of any one of Embodiments E1-E3, wherein the signal of a virus i is a nucleic acid comprising a nucleotide sequence that is present in that virus and not in any other virus j.

E5. The composition, method, or plurality of any one of Embodiments E1-E3, wherein the signal of a virus i is a surface protein comprising an epitope that is present on that virus and not on any other virus j.

F1. The composition, method, or plurality of any one of Embodiments A1-C18, wherein the mixed population comprises at least two eukaryotic cell types.

F2. The composition, method, or plurality of Embodiment F1, wherein reference standard abundance of eukaryotic cell types is measured in eukaryotic cell genome copy number.

F3. The composition, method, or plurality of Embodiment F1 or F2, wherein the signal of a eukaryotic cell type i is a metabolite produced in that eukaryotic cell type and not by any other eukaryotic cell type j.

F4. The composition, method, or plurality of Embodiment F1 or F2, wherein the signal of a eukaryotic cell type i is a metabolite consumed by that eukaryotic cell type and not by any other eukaryotic cell type j.

F5. The composition, method, or plurality of Embodiment F1 or F2, wherein the signal of a eukaryotic cell type i is a nucleic acid comprising a nucleotide sequence that is present in that eukaryotic cell type and not in any other eukaryotic cell type j.

F6. The composition, method, or plurality of Embodiment F1 or F2, wherein the signal of a eukaryotic cell type i is a cellular morphology distinguishable from each other eukaryotic cell type j.

F7. The composition, method, or plurality of Embodiment F1 or F2, wherein the signal of a eukaryotic cell type i is a surface protein expressed by that eukaryotic cell type and not on any other cell type j.

F8. The composition, method, or plurality of any one of Embodiments F1-F7, wherein the mixed population comprises cells of eukaryotes belonging to different species.

F9. The composition, method, or plurality of any one of Embodiments F1-F7, wherein two or more eukaryotic cell types of the mixed population are distinct cell types of the same eukaryotic species.

G1. The composition, method, or plurality of any one of Embodiments A1-C18, wherein the mixed population comprises at least two animal cell types.

G2. The composition, method, or plurality of Embodiment G1, wherein the animal is (i) a vertebrate; (ii) a mammal; (iii) a mouse; or (iv) a human.

G3. The composition, method, or plurality of Embodiment G1 or G2, wherein the animal is a mammal, and each mammalian cell is (i) a stem cell; (ii) a hematopoietic cell; (iii) a myeloid cell; (iv) a neutrophil, monocyte, macrophage, dendritic cell, eosinophil, or basophil; (v) a lymphoid cell; (vi) a natural killer cell, B cell, or T cell.

G4. The composition, method, or plurality of any one of Embodiments G1-G3, wherein reference standard abundance of population members is measured by flow cytometry analysis of proportional abundance combined with an independent measurement of total cell abundance.

G5. The composition, method, or plurality of any one of Embodiments G1-G4, wherein the signal of an animal cell type i is a surface protein expressed by that animal cell type and not on any other cell type j.

EXAMPLES

Example 1: Methodology of Most Probable Number (MPN) Measurement and Correction This Example describes a method for quantifying live organisms in a mixed population using most probable number (MPN) estimation, corrected for bias introduced by interactions between individual members of the population during incubation during MPN measurement.

A. Reagent Preparation

Diluent, growth media, and other consumables are pre-reduced in anaerobic environment if any bacteria being quantified are sensitive to the presence of oxygen. Pre-reduction is carried out for a duration sufficient to provide reagents that do not negatively affect the growth of oxygen-sensitive bacteria.

B. Serial Dilutions

The sample being analyzed is suspended in a diluent and diluted in one tube or serially diluted across multiple tubes. Pre-dilution brings the concentration of the sample to a low enough concentration such, in the next step (dilution for incubation and MPN determination), some wells have a substantial probability of being inoculated by at least one colony-forming unit (CFU) of the strain being quantified and other wells have a low probability of being inoculated with any CFUs of the strain.

The pre-diluted sample is serially diluted across one or more replicate series (e.g., 7 replicated dilutions of 12 3-fold serial dilutions). The following parameters may be modified in design of a dilution series:

1. Number of dilutions: Together with the between-well dilution amount, determines the dilution range. A higher number of dilutions increases the dilution range, expanding the range of quantification.
2. Between-well dilution: Together with the number of dilutions within each replicate dilution series, determines the dilution range. The between-well dilution may be the same between all pairs of wells so that the pipette used for serial dilutions does not need to be adjusted between dilutions, but the MPN calculation can be performed with any arbitrary set of dilutions.
3. Dilution range: Determines range of analyte concentrations that can be quantified.
   a. Minimum dilution: Each strain must have at least one CFU in some wells at the minimum dilution to be above the lower limit of quantification. Precision of calculated MPN is increased when many wells of growth are present.
   b. Maximum dilution: Each strain must have zero CFUs in some wells at the maximum dilution to be below the upper limit of quantification. Precision of calculated MPN is increased when many wells without growth are present.
4. Total number of growth wells: In general, determines the precision (e.g., % RSD). All growth wells contribute to the MPN calculation, even if no growth is observed in the well or if all wells at a given dilution level have growth. The effect of growth outcomes in any given well on the calculated MPN depends on how close the probability of the well having zero CFUs is to the probability the well has 1 or more CFUs. Selecting the between-well dilutions and number of dilutions such that many wells with growth and without growth are likely to occur will increase precision.

C. Incubation

The MPN plate is incubated as necessary to elicit the biological phenomenon being observed to infer initial presence of a population member in a well. In the present example concerning a bacterial population, the MPN plate is incubated at a temperature conducive to bacterial replication to allow any CFUs that are initially present in each well to proliferate. The incubation time is chosen as one that is sufficient for any component of the population to elicit the biological phenomenon of interest (e.g., growth) to a detectable level.

D. Signal Detection

After incubation, the MPN plate is processed to detect the presence or absence of a signal of each bacterial strain. These signals may include:

- Presence of strain-specific nucleic acids (detected via any method capable of confirming presence of specific nucleotide sequences in a sample, e.g., qPCR);
- Production of strain-specific metabolites (detected via spectroscopy, e.g., NMR spectroscopy, mass spectrometry, FTIR spectroscopy);
- Consumption of strain-specific metabolites;
- Identification of distinguishing morphology (detected via microscopy, e.g., by a blinded observer);

Any other signal that requires growth of input strain for observance.

As one example, detection of strain-specific nucleic acids by qPCR proceeds as follows:

DNA is extracted from each well;

Crude DNA extracts are further purified using a magnetic bead-based purification method;

Purified DNA from each well is amplified by real-time qPCR using strain-specific PCR primers. Each strain is identified as present or absent based on whether the cycle threshold (Ct) of the reaction using its corresponding primers is above (absent) or below (present) a control Ct cutoff determined by a set of standards run on the same qPCR plate.

E. Unadjusted MPN Calculation

The unadjusted MPN of each strain is calculated using the presence or absence determinations for that strain in each well of the MPN plate, in combination with the known conditions of the MPN assay (including extent and number of dilutions, and number of replicates at each dilution). Patterns of co-occurrence with or without any other strains are not a factor in calculating unadjusted MPN.

In this example, MPN is calculated as described by Martini et al., *Microbiol Spectr.* 2024. 12(9):e0394623, but other methods of calculating MPN are also available. See, e.g., Thomas, *J Am Water Works Assoc.* 1942. 572-576.

F. Adjusted MPN Calculation

For each strain, adjusted MPN is calculated by correcting its unadjusted MPN using previously collected calibration data from samples containing samples with variable but known quantities of the strains of the population. This correction accounts for conditions of the MPN assay that allow interactions between the strains to influence the probability of observing the signal of that strain. As one example, during the incubation step, some strains may grow faster or to a greater population size than other strains of the population. If a given well contains a sufficiently higher initial abundance of one strain, that strain may limit or exhaust nutrients from the media that are required by other strains that are present at lower initial abundances. Competition in this circumstance may prevent such less abundant strains from growing to an extent their signals are detectable, making those wells false negatives with respect to those strains and consequently causing underestimation of their MPN. Correction using previously collected calibration data corrects for this bias introduced by antagonistic or synergistic interactions between strains in the MPN assay.

Multiple models may be formulated, each of which improves precision and/or accuracy of calculated MPN. Each model relies on calibration data collected using one or more calibration samples having reference standard abundances of each strain being quantified, with those reference standard values being determined by testing single-strain populations and combining portions of those single-strain populations to produce calibration samples with known abundances of each strain.

As a first example, the following linear equation is fit:

$$CFU_{i,k} \sim \sum_{j=1}^{j=N} \beta_{i,j} * S_{j,k}$$

N is the number of distinct strains being quantified;

$CFU_{i,k}$ is the $\log_{10}$-transformed reference standard abundance (in CFUs) for strain i in calibration sample k, with i=1, 2, . . . N and k=1, 2, . . . to the number of samples in the calibration data;

$S_{j,k}$ is the $\log_{10}$-transformed unadjusted MPN computed for strain j from calibration sample k (the most probable number of viable cell units solved for in the MPN equation using only growth/no-growth data for strain j and the dilution information for each well), with j=1, 2, . . . N;

$\beta_{i,j}$ is the regression coefficient describing the linear contribution of $S_j$ (across all samples k) to $CFU_i$ (the impact of strain j on strain i as a function of the unadjusted MPN for strain j. When j=i, $\beta_{i,j}$ is the contribution of the unadjusted MPN to the CFU output for the same strain).

As another example, the effect of one strain on another may be represented through the difference between (i) the initial MPN of the strain being quantified and corrected and (ii) another strain that potentially influences the first strain's quantification. This representation accounts for the possibility that if one strain is present at higher abundance than another strain in a population, many wells of an MPN plate will contain the more abundant strain but not the less abundant strain. Thus, the less abundant strain in the population has less opportunity to interact with the more abundant strain in the MPN assay, and calculation of the more abundant strain's MPN is less subject to bias from interactions with the less abundant strain. This formulation is represented by the equation:

$$CFU_{i,k} \sim \beta_i * S_{i,k} + \sum_{j=1}^{j=N} \beta_{i,j} * (S_{i,k} - S_{j,k})$$

where $S_{i,k}-S_{j,k}$ is substituted with zero when $S_{i,k}-S_{j,k}<0$.

Example 2: Adjusted MPN Measurement of Eight Bacterial Strains in a Defined Consortium This Example describes execution of a multistrain most probable number (MS-MPN) assay, from reagent preparation, through serial dilution, co-culture growth, qPCR-based strain detection, and analysis.

Medium Preparation

Partially Defined Media 7 version 3 (PDM7v3) liquid medium was prepared to support detectable co-culture growth of all eight VE303 bacterial strains. First, a 4 L glass beaker containing 700 mL of Milli-Q water was placed on a stir plate operating at 270 RPM with no heating. Three stock solutions containing light-sensitive components were prepared in advance: 0.5% Phytonadione in 10.0 mL ethanol; 100 mM Iron (III) chloride in 10.0 mL water; and 1 mM Cyanocobalamin in 40.0 mL water. Then, the dry components were systematically added to the stirring water in the following order:

10.0 g Dextrose as the primary carbon source;

16.6 g Yeast Extract as an undefined source of amino acids, peptides, and other nutrients;

10.3 g Succinate;

4.5 g Myo-inositol;

0.350 g L-Cysteine Hydrochloride, and various phosphates and sulfates to supply essential nutrients and reducing capacity.

Complete dissolution of all dry ingredients was ensured through continuous stirring before proceeding to the next step. Following complete dissolution of the dry ingredients, the prepared stock solutions were added: 0.2 mL Phytonadione stock; 0.076 mL Iron (III) chloride stock; and 0.1 mL Cyanocobalamin stock. The order of addition was used to ensure uniform dissolution and prevent precipitation. pH adjustment was performed using 10 N Sodium Hydroxide to achieve the target pH range of 7.0-7.2. The initial pH of approximately 6.2 was adjusted through systematic addition of small NaOH aliquots, requiring 1.5-2.0 mL total to reach the final pH of 7.0-7.2. Mixing periods of 2-3 minutes were maintained between each addition to ensure complete equilibration and prevent pH overshoot.

The final processing of the media involved sterile filtration through a 0.2 m polyethersulfone (PES) membrane using vacuum filtration. The filtered medium was collected in a sterile bottle and immediately wrapped in aluminum foil to protect light-sensitive components from degradation. The final conductivity was 13.62 mS/cm, indicating proper ionic strength for bacterial growth. The prepared medium was stored at 5° C.

Material Pre-Reduction and Preparation

All materials required for the MS-MPN assay were pre-reduced in an anaerobic chamber to remove dissolved oxygen before use. Accordingly, the previously prepared PDM7v3 broth and 1× phosphate-buffered saline (PBS) were placed in the anaerobic chamber with caps completely unscrewed for 70.75 hours. Throughout the pre-reduction period, the aluminum foil wrapping from media preparation was maintained to continue protecting light-sensitive components. After completion of reduction, caps were fully secured while maintaining the anaerobic environment. Plastic consumables including 15-mL conical tubes, 96-well microplates, and 96-well deep-well plates were pre-reduced for 166.4 hours. The tubes had caps completely unscrewed but resting on top to allow gas exchange, while plates were covered with breathable membranes and stored without stacking to ensure adequate gas exchange.

On the day of sample processing, dilution vessels were prepared using the pre-reduced reagents. Three "PBS Dilution Tubes" were prepared per drug product capsule by adding 9 mL of pre-reduced PBS to sterile, pre-reduced 15-mL conical tubes. One "PDM7v3 Dilution Tube" was prepared for each capsule by aseptically adding 6 mL of the pre-reduced PDM7v3 broth prepared in the preceding section to sterile 15-mL conical tubes. Deep-well plates were prepared with 300 μL of pre-reduced PDM7v3 broth added to each well, maintaining the sterility and light protection established during medium preparation. The plates were covered with breathable membranes and staged within the anaerobic chamber for immediate use in the serial dilution procedure.

Sample Preparation and Serial Dilution

A consortium had been blended from eight independent strains with a target titer of $3.333\times10^8$ CFU per capsule per strain, based on spread-plating assay (Table E2-1, leftmost column). Consortium capsules were removed from designated storage areas and thawed at room temperature for 30-60 minutes. During this thawing period, all pre-reduced reagents and prepared dilution vessels were staged within the anaerobic chamber. Each capsule was opened by separating the ends, and the entire contents were dispensed into a pre-weighed 50-mL conical tube. The final weight was recorded to four decimal places to enable accurate concentration calculations (0.4294 g). Sample tubes were labeled, then transferred to the anaerobic chamber pass box and subjected to a purge cycle according to standard chamber operating procedures.

Following transfer to the chamber interior, sample tubes were allowed to equilibrate in the anaerobic environment for 1 hour with caps loosened to ensure complete oxygen removal. This equilibration period was used to maintain the viability of oxygen-sensitive bacterial strains during subsequent processing steps.

After equilibration, capsule contents were resuspended in pre-reduced 1×PBS to achieve a final concentration of 10 mg/mL. The resuspension process employed a two-step addition method: 20 mL of PBS was added initially, followed by vortexing for 10 seconds three times with visual inspection of homogeneity between each vortex step. If clumps remained visible, aspiration and dispensing with a serological pipette was performed to break up aggregates. The remaining calculated volume of PBS was then added, and the vortex procedure was repeated to allow complete homogenization.

Serial dilutions were performed immediately after resuspension to achieve a 3,000-fold total dilution of the consortium material. The first three dilutions were 10-fold dilutions carried out by transferring 1 mL of sample into the pre-prepared tubes containing 9 mL of pre-reduced PBS. Each dilution was thoroughly mixed by vortexing for 5-10 seconds three times before proceeding to the next step. A final 3-fold dilution was performed by adding 3 mL of the $1\times10^3$ dilution to the tube containing 6 mL of pre-reduced PDM7v3 broth prepared in the "Medium preparation" section.

The final diluted sample was used to inoculate the pre-pared 96-well deep-well plates by transferring 150 μL to each well in column 1. Serial dilutions across the plate were achieved by performing 11 successive 3-fold dilutions, transferring 150 μL from each well to 300 μL of pre-reduced PDM7v3 broth in the subsequent column. Thorough mixing was accomplished by pipetting up and down 10 times at each step, with pipette tips changed between dilution levels to prevent carryover contamination.

Bacterial Culture and Incubation

Two separate plates were prepared from each dilution series to enable both growth monitoring and baseline control measurements. The outgrowth plate was prepared by transferring 200 μL from rows A-G of the deep-well plate to a 96-well microplate using a multichannel pipette. Row H was left empty in the outgrowth plate to maintain consistent plate geometry. The $T_0$ control plate was prepared by transferring 200 μL from row H of the deep-well plate to a second 96-well microplate, which served as a baseline measurement of bacterial DNA present before growth amplification.

The outgrowth plates were sealed with breathable membranes and incubated at 37° C. for 72 hours in the anaerobic chamber. The light protection established during PDM7v3 preparation was maintained throughout the incubation period by keeping the chamber interior dimly lit or covering plates with foil if excessive light exposure occurred. Two 500 mL bottles filled with at least 250 mL of distilled water were placed in the incubator to maintain humidity and prevent plate desiccation during the extended incubation period. The $T_0$ control plate was immediately sealed with sterile adhesive film and stored at −80° C. to preserve the baseline bacterial DNA content for later analysis.

Following the 72-hour incubation period, outgrowth plates were removed from the anaerobic chamber and assessed for validity before proceeding to DNA extraction. Optical density measurements at 600 nm ($OD_{600}$) were recorded for all wells in rows A-G using a spectrophotometer. If liquid droplets were observed on the breathable membrane, plates were centrifuged at 1,000×g for 10 seconds to collect condensation before OD measurement.

Validity criteria were applied to ensure proper dilution series performance and adequate bacterial growth. Plates were considered invalid if more than three wells in column 12 (rows A-G) had $OD_{600}$ values exceeding 0.300, indicating insufficient extinction of growth across the serial dilution range. Conversely, plates were invalid if more than four wells in column 1 had $OD_{600}$ values below 0.300, suggesting inadequate initial bacterial growth. The pH range established during PDM7v3 preparation supported bacterial growth and helped prevent these validity failures.

Valid plates proceeded immediately to DNA extraction, while invalid plates required replacement capsule testing using fresh medium prepared according to the "Medium preparation" section. For testing of 12 capsules, no more than one replacement capsule was required before the entire test was considered invalid. The validity assessment ensured that subsequent qPCR analysis would yield reliable strain-specific enumeration data.

DNA Extraction and Purification

DNA extraction began with the preparation of cultures from valid outgrowth plates and thawed $T_0$ control plates. The $T_0$ plates were removed from −80° C. storage and thawed at room temperature for at least 20 minutes before processing. Outgrowth plate cultures were transferred to 96-well PCR plates in 50 μL aliquots, with duplicate plates prepared for each sample to provide backup material if needed. Row-by-row mixing was performed using a multichannel pipette set to 50 μL, with 10 up-and-down pipetting cycles to homogenize each culture before transfer. Foam formation was minimized by keeping pipette tips submerged in the liquid during mixing.

The $T_0$ control samples were similarly mixed and transferred to row H of the PCR plates, providing baseline bacterial DNA measurements from before growth amplification. All extraction plates were sealed with foil, labeled with assay batch name, consortium number, extraction replicate number, and analyst initials/date, then stored at −80° C. if not proceeding immediately to extraction.

Enzymatic treatment initiated the DNA extraction process using a combination of metapolyzyme and buffer systems. Fresh metapolyzyme solution was prepared by reconstituting three vials of DNA-free metapolyzyme with 125 μL of 1×PBS each, combining into a single vial containing 375 μL total volume sufficient for one 96-well plate. The reconstituted enzyme solution was stored at 2-8° C. and was used within 24 hours of preparation.

The extraction process began by adding 5 μL of 10×PBS and 2.5 μL of reconstituted metapolyzyme solution directly to each well containing bacterial culture. Thorough mixing was achieved using a multichannel pipette set to 40 μL aspiration volume, pipetting up and down 5 times per well. The plates were sealed with clear adhesive film and incubated at 35° C. with shaking at 220 rpm for 2 hours to allow enzymatic breakdown of bacterial cell walls.

Following enzymatic treatment, chemical and thermal lysis steps were performed to complete cellular disruption and protein denaturation. After centrifugation at 500×g for 20 seconds, 6 μL of 20×TE buffer and 10 μL of 1 mg/mL proteinase K solution were added to each well. Chemical lysis was completed by adding 57.5 μL of 1% IGEPAL solution with careful mixing to avoid bubble formation that could interfere with subsequent steps.

The sealed plates were subjected to thermal lysis using a thermal cycler programmed for 60° C. for 1 hour followed by 95° C. for 15 minutes. This two-step thermal treatment ensured complete protein denaturation while preserving DNA integrity. Following thermal lysis, cell debris was pelleted by centrifugation at 3,849×g for 15 minutes, and 60 μL of clear supernatant was carefully transferred to fresh PCR plates for purification, avoiding disturbance of the pellet.

DNA purification employed AMPure XP magnetic bead technology to remove proteins, salts, and other contaminants while retaining high-quality DNA. The bead suspension was equilibrated to room temperature for at least 30 minutes and thoroughly vortexed for 10 seconds three times before use. Approximately 108 μL of resuspended beads (1.8:1 bead-to-sample ratio) were added to each 60 μL sample and mixed thoroughly by pipetting up and down 5 times.

DNA binding to the magnetic beads was allowed to proceed for 20 minutes at room temperature before plates were placed on magnetic racks for bead capture. The supernatant was carefully removed by positioning pipette tips at an angle away from the magnetic side of wells to avoid disturbing the bead pellet. Two wash steps were performed with 200 μL of 80% ethanol each, with 30-second incubation periods between washes to remove of contaminants.

After the final wash removal, plates were air-dried for up to 60 seconds until no visible ethanol droplets remained, taking care to avoid over-drying and associated reductions in DNA yield and quality. The pellets appeared matte but not cracked. DNA was eluted by adding 40 μL of 1×TE buffer containing 0.05% Tween-20 and incubating at room temperature for 5 minutes with occasional gentle mixing. Following magnetic separation, approximately 40 μL of clear supernatant containing purified DNA was transferred to fresh PCR plates, avoiding any residual magnetic beads that might interfere with downstream applications.

Quantitative PCR Analysis

Quantitative PCR enabled strain-specific detection and quantification using unique primer sets targeting each of the eight VE303 bacterial strains. Working primer stocks were prepared at 20 M concentration from 100 M stock solutions. The primers were reconstituted in molecular biology-grade water, with working stocks prepared by mixing 100 μL of stock primers with 400 μL of water.

Limit of detection (LoD) standards were prepared by serial dilution of a multi-gene double-stranded DNA standard to establish detection thresholds for each strain. The standards were prepared fresh for each assay, starting with a $1\times10^8$ copies/L stock and creating eight concentration levels: 500, 100, 50, 25, 12.5, 6.25, 3.125, and 0 copies/L (water control). Each standard level was prepared in 60 μL aliquots in 8-strip PCR tubes, with each strip containing a complete dilution series. The standards were stored at −80° C. and used within one year of preparation.

qPCR reactions were assembled in 384-well plates using an automated I.DOT dispensing system to provide precision and reduce pipetting errors. Each reaction contained 1 μL of DNA template and 9 μL of strain-specific master mix, resulting in a final reaction volume of 10 μL. The DNA template layout accommodated samples from three MPN plates in separate quadrants of each 384-well plate, with the fourth quadrant containing LoD standards and controls.

Master mix composition varied by strain to provide amplification efficiency and specificity for each. The typical formulation contained 4.5-5.0 μL of PowerUp SYBR Green master mix, 3.1-4.1 μL of molecular-grade water, and 0.15-0.45 μL each of forward and reverse primers at 20 M concentration. The exact volumes were adjusted based on empirically determined suitable primer concentrations for each strain, with preparations including 20% excess to account for pipetting losses and ensure sufficient volume for all reactions.

The automated dispensing process began with DNA template addition using the I.DOT system programmed with strain-specific protocols. Each 384-well plate received 1 μL of DNA template per well from the appropriate quadrant, with visual inspection performed after each dispensing step to ensure proper volume delivery and absence of droplets outside wells. Any flagged wells with insufficient dispensing were corrected using the backfill function, with manual addition of 10 μL directly to source wells if volume depletion occurred.

Master mix dispensing followed template addition, with 9 μL of strain-specific master mix added to each well using the same automated system. The master mix was prepared fresh for each strain and transferred to sterile reagent reservoirs, then loaded into the I.DOT source plates for dispensing. Eight separate 384-well plates were prepared for each set of three MPN samples, with each plate containing reactions for one of the eight VE303 strains.

Thermal cycling was performed using a QuantStudio 7 Pro system with automated plate handling via an Orbitor robotic system. The cycling protocol consisted of an initial denaturation at 95° C. for 2 minutes, followed by 40 cycles of 95° C. for 15 seconds, 53° C. for 15 seconds, and 72° C. for 45 seconds with signal acquisition during the extension step. A melt curve analysis was included to verify product specificity and detect potential primer-dimer formation.

Quality control assessment was performed on all qPCR results before proceeding to data analysis. Critical validity criteria included assessment of extinction patterns, negative control contamination, and $T_0$ baseline measurements. The qPCR test was considered invalid if any of three specified well ranges (A12-G12, I12-O12, or I24-O24) contained four or more wells with determined Ct values below 30.0, indicating insufficient dilution extinction. Similarly, contamination in negative controls was assessed by examining the LoD standard quadrant for unexpected amplification signals.

$T_0$ control assessment was used to determine that baseline bacterial DNA levels were appropriate for reliable quantification. If all $T_0$ samples in any quadrant showed determined Ct values, this indicated potential contamination or processing errors requiring repeat analysis. These validity checks ensured that subsequent MPN calculations would be based on reliable growth/no-growth determinations across the dilution series.

Data Processing and Results Calculation

Data analysis was conducted using computational software that processed qPCR results and applied MPN algorithms to calculate strain-specific viable cell counts. The complete data processing workflow encompassed approximately 2-3 hours of computational analysis following qPCR completion. Raw qPCR data files were transferred from the thermal cycler system to a designated analysis computer. A bespoke, validated software system was used to process and analyze the data.

Limit of detection standard analysis was performed first to establish strain-specific detection thresholds for binary classification. The software processed qPCR data from control samples containing defined concentrations of target DNA ranging from high to low copy numbers plus negative controls. For each strain, cycle threshold (Ct) values from multiple technical replicates at each concentration level were statistically analyzed to identify the lowest concentration achieving consistent detection. The detection threshold was calculated as the average Ct value at this concentration level, typically ranging from 30-35 cycles depending on the strain and primer efficiency.

Quality control assessment of the standards included evaluation of variability across replicates and identification of outlier values that might indicate experimental errors or contamination. The calculated thresholds were applied consistently across all sample wells for each respective strain to ensure uniform classification criteria.

Binary growth classification was performed by comparing each sample's Ct value to the established strain-specific threshold. Wells with determined Ct values below the threshold were classified as "present" (indicating bacterial growth occurred), while wells with undetermined Ct values or values above the threshold were classified as "absent" (no detectable growth). This binary classification created a growth/no-growth matrix for each strain across the entire dilution series.

Data quality assessment was performed before MPN calculation to identify potential experimental errors or contamination events. Extinction pattern validation confirmed that adequate dilution to extinction was achieved by verifying limited growth in the most dilute wells. Contamination assessment evaluated negative control wells for unexpected amplification signals. Baseline sample evaluation ensured appropriate starting bacterial DNA levels by confirming that pre-incubation samples showed minimal amplification compared to post-growth samples.

Most probable number calculations were performed using maximum likelihood estimation algorithms that determined the bacterial concentration most likely to produce the observed growth/no-growth pattern. The software followed established MPN equations to relate key experimental parameters (serial dilution number k, inoculum volume z, number of wells per dilution, n) and binary growth observations (x) to the viable cell concentration (λ) in the original sample. Numerical methods algorithms were applied to this equation, iteratively testing different bacterial concentrations until finding the value that maximized the probability of generating the observed data pattern, yielding raw MPN estimates. As a quality control measure, minimum required observations of growth and no growth wells were established as data validity criteria.

$$\sum_{j=1}^{k} \frac{x_j z_j}{1 - e^{\lambda \cdot z_j}} = \sum_{j=I}^{k} n_j z_j$$

Bias correction was applied to the raw MPN estimates using strain-specific linear regression equations developed during method qualification to account for competitive and cooperative interactions between bacterial strains during co-culture growth. The correction employed mathematical models where each strain's corrected value was calculated as a linear combination of raw MPN estimates from all strains present, with coefficients determined through statistical analysis of defined mixture studies (Table E2-2).

The bias correction equations incorporated multiple variables, with coefficients reflecting the magnitude and direction of inter-strain interactions observed during qualification studies. For example, one strain's corrected value might be calculated as:

$$\text{Corrected Value} = C_1 \times (\text{Raw } MPN \text{ Strain } 1) + C_2 \times (\text{Raw } MPN \text{ Strain } 2) + \ldots + C_8 \times (\text{Raw } MPN \text{ Strain } 8),$$

where $C_1$ through $C_8$ represent empirically determined coefficients, as listed in Table $E2-1$.

The mathematical operations were performed on $\log_{10}$-transformed CFU values to accommodate the wide dynamic range of bacterial concentrations. After bias correction, unit conversions were performed by considering the precise sample weights recorded during preparation to calculate CFU per unit dose values. The bias-corrected MPN values were multiplied by appropriate dilution factors and converted using the sample mass (429.4 g per capsule) to yield final strain-specific abundances (Table E2-2). As shown in Table E2-2, bias correction improved the accuracy of most MPN estimates. In particular, the average absolute deviation of estimates was reduced by 33% (0.410 $\log_{10}$ (2.58-fold, uncorrected) v. 0.273 $\log_{10}$ (1.87-fold, corrected)), and all corrected estimates were within 0.60 $\log_{10}$ (~4-fold) of the reference standard abundances estimated by spread plating.

The bias correction coefficients were derived during method qualification studies using defined mixture experiments with known strain compositions spanning a 400-fold concentration range. These mixtures were processed through the complete MS-MPN workflow and the resulting values were compared to reference standard concentrations determined by independent quantification methods. Statistical regression analysis identified systematic interaction effects where certain strains influenced the apparent quantification of others in co-culture, yielding strain-specific correction equations that compensated for both competitive and cooperative effects observed during multi-strain growth.

TABLE E2-1 shows model coefficients used to correct MS-MPN abundance estimates for matrix effects in a multi-strain outgrowth environment. Coefficients were estimated by correlating MPN assay readouts to reference standard values for defined mixture experiments with known strain compositions.

| | VE303-01 | VE303-02 | VE303-03 | VE303-04 | VE303-05 | VE303-06 | VE303-07 | VE303-08 |
|---|---|---|---|---|---|---|---|---|
| $C_1$ | 1.05 | | | | | | 0.03 | 0.05 |
| $C_2$ | | 1.01 | −0.06 | | −0.03 | | | |
| $C_3$ | | | 1.03 | | | | | −0.03 |
| $C_4$ | | 0.11 | | 1.04 | | | | −0.04 |
| $C_5$ | | | | 0.03 | 1 | | | |
| $C_6$ | 0.05 | | 0.1 | | 0.03 | 0.98 | | 0.04 |
| $C_7$ | | 0.1 | −0.07 | | | | 0.99 | |
| $C_8$ | | −0.12 | 0.05 | | | | | 1.01 |

TABLE E2-2 shows a comparison of viable titers of the multi-strain sample across reference standard values (as measured by spread plating) and MS-MPN assay readouts, in units of $\log_{10}$ CFUs per capsule. Reference standard values were estimated by measuring abundance in individual strain materials by agar spread plating before blending into a multi-strain mixture.

| | $\log_{10}$ CFU by agar-spread plating (reference standard) | $\log_{10}$ CFU by MS-MPN (uncorrected) | $\log_{10}$ CFU by MS-MPN (bias corrected) | Difference from reference standard (uncorrected) | Difference from reference standard (corrected) | % reduction in magnitude of deviation (absolute difference) by bias correction |
|---|---|---|---|---|---|---|
| VE303-01 | 8.522878 | 8.215127 | 9.05481 | −0.30775 | 0.53193 | −73% |
| VE303-02 | 8.522878 | 7.980938 | 8.749914 | −0.54194 | 0.22704 | 58% |
| VE303-03 | 8.522878 | 8.254699 | 8.73043 | −0.26818 | 0.20755 | 23% |
| VE303-04 | 8.522878 | 7.912598 | 8.466263 | −0.61028 | −0.05662 | 91% |
| VE303-05 | 8.522878 | 7.905357 | 7.923284 | −0.61752 | −0.59959 | 3% |
| VE303-06 | 8.522878 | 8.578516 | 8.406946 | 0.05564 | −0.11593 | −108% |
| VE303-07 | 8.522878 | 7.991069 | 8.157612 | −0.53181 | −0.36527 | 31% |
| VE303-08 | 8.522878 | 8.169381 | 8.440827 | −0.35350 | −0.08205 | 77% |
| Mean | 8.522878 | 8.125960625 | 8.491261 | −0.39692 (actual difference) 0.41083 (absolute deviation) | −0.03162 (actual difference) 0.27325 (absolute deviation) | 33% (absolute deviation) |

EQUIVALENTS AND SCOPE

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

The indefinite articles "a" and "an," as used herein in the specification and in the claims, unless clearly indicated to the contrary, should be understood to mean "at least one." It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

The terms "about," "approximately," and "substantially" preceding a numerical value mean±10% of the recited numerical value.

Where a range of values is provided, each value between and including the upper and lower ends of the range are specifically contemplated and described herein.

SEQUENCE LISTING (118 sequences)

SEQ ID NO: 1 - DNA, 3477447 bp, unidentified (residues 1-1,738,724 of 3,477,447)
  source 1..3477447: mol_type = genomic DNA; note = Thomasclavelia sp000508865
tttactaactggacagatgctagtgttaacaatcgtgataaagttattgattttgattataaagaaataaattctatggatcacgttgatatttatcctcatagtagttatttaaaccaacaacctcgagaagtaactattttaggaagtcttgatggtattaactttacaactgtagtagataaagtacagttatccaatgattcatctgttaagtcaattgctttaaatggtgctaaaatgcgttatatgagaatggttatttcaaaaccagctggaacttatgtatgtatgacagaagttatgccatataaagtagatggttcaaaaacatatccagtaggtgatgtaactttagatggtaaagttgatagcaatgatttaacatggattgaaaactatacaggattaacaaataaagattcagactttacttatgtatcacaaacaaataatgctgatattaatggcgataatgtaatagatgcttatgatatttcttatattacaactaaattagatggtggtactaataaaactggtaatcctgatggaaagataatgttgattgccgataaaaatgaagtaaaagctgaagaaactgttaatattactttacttggtgtaggtttgaagaatattaatgctttcagtgaagttcttccaattgacactgataacttctcttacgaaggatatcgtcagtcatatgatgtaattgatatgatgacaatagctaaaatgagagctagaactattggaagtgagttaacgatcgttagtacaaatataggagatcaagatttggtaaatggtacaattaagcttggtactattacattaaaagcaaaaactgatacaacttttgcattaactaatggtattgcaaaattaataggaccaaagttatcatatattgatgctaatattgatggtgatacgataattcctgaaactcctgataaagttgaaacagcagtagaagtaaaagagacaacaattacaaataatgcatatccaactgatgatggaactaatgttgataaattgattcaacaaaattcttttgatgcattatacaatggtgctgctgatgaagaatttgaattaaaatgggatattgaagataatcaagtagatggtgtattaaaaccagaaattacattacctgtaaatctacatttagatatggacggacaattaatgaatattgtacgtatttatggacgcccaactggaaatggagctccacgtgttgtaagtgctaatgtagttactacagatggcacaacaattgatttaggtacgataggaagttattcattagatagtagtggcaatccaacatacactaactatccaagtgatggagtattcacttttgaattagatgaagcagtagaagttaagacagtaaatattacttttgaacatgcgacaggtattgctggtgattcaaataatccatacgatcgtatgttaacattaagagaaatcgaatgtgcatatgcacatgatgttccagttacaggaattactttagacaaaaataataaagaaactttatatgtaggaagtttaagtgactttagtgctaaagttagccctaatgatgcattaaatccttattacacagtaacaagtgatgacgaagatgtagttaaagtattaactattaaaacagaaagtggatttgcatttatgttgcagccattaaaagaaggcactgcaaaaattacagcaacttcagtagataataatgaaatttcagttactcaaactgtaacagtaaaaacaggaactgatacaaatacactaatagatatcttaaatcaagcagaagctttaaataaagatttctatactattgatagttatactgtattatcgaatgtaattagtgaagcaaaggacctattaactaatagtccaactcaagatcaagtagatcaagtagtaagtaaaattaaacgagcaatcaaaacactagaattaaaagctgtaaatccagctaatcgtattgaaaatatagctgtagttgaatcaagtggagaagctagtcgcagtgaaggtgcagctaatattttagataatgatattggttcatattggttaagtacatcaagtggtatgccacaatgggttgttgttgatttaggaagcatatataaattaagtgatgtaacattcttacctcgtcaaggtggaaataatggtgatatcattaaagctgctatatcagtaagtacagatggtcaagattatatagatcttggacaatttgaatttgacaatgatggtactaaattacttgataaaactgtatttaaacaaatgaaatttataccaacagatgcaagatatgttaaagtgactattttagaaacattaggaaatcctattaatagttgcgtaagtgtagcagaaatgcgtttctatggtagtgtagatgtagataagagtgaattacaagcattatatgatgaatatttaactcttaaagaagaaaactttacaacagaaacttgggtactgttctctaatgcaatgacagatgctaagagtatgttagatagagaagatgcaactcaagatgaagtaaatacagttaaatctgcattagtggttgctagaggagcattagttgaaaaagttattgaaactaataaattagcattagctatagctattgatatggcagaagctgcagatttagaaaatgtcgtacctgtagtagtaactgaattcaatgaagcattagaaaatgctaaagcagtatacagtaatgaaaaagctactcaagaagaagtaaataatgcctttgatcgactagcaagtgcaatgcagatgttggaattctacaaaggtgacaaaacagcattacaaaaacaagtagatcaaatcaatggattagatgaaagtaaatacattgaatcatcatggtctgatatgttaccagcattagataaagctaatgatgtattagctgatgaaaatgcaatgcaagatgaagttgatgaagtatttacagaattagtaaaagcattcttgaacttaagattaaaaccaaataaagacttattacaagagttgatcaataaggcaaatagcttaaacgctgcaaattatagtgctaaaacatgggcagtagtcgcagatgctttaaatgaagcaaaagcggtattagaagatccagaagcaacacaagcagaagtagataaggcaaaagctgtcttaatgaaaggattagctgaattacaaactgtcaatatagcagatatgaatgtatcagcaccagtaaaatctggagatacgacagtaagtataaaaacaggtgatgatataactattattacaccaattacaatgttggcattaagtactgctttatactatctttctaaaaagaaaaaatattggaattaaaaattaaattgtatttaatagtatataaaatatattaaatctaaagagtggtggtaacactgctctttaatttttgaaaaatattaaaaaggatagttatataatatttataaattaaattatatataacttgacaatttttttaatatattataatgtattaacatactattcatataggaaaagaggtaaaagttatgaactttgtattagaactacaattacgaaataattttagaatgggacgatgttgttgctgtttttttaataaagagtaacaatttaattatattgtgctctttattctaatatacattaaagagaaaaggggacaattaaatgaataaaaatattttagaattaggagctttagtgcttgctgttatattttttatattaatttattttcttaaaaagaaaaaagttgattttagtgtgctaactattttagcagtaggtttaggaataatagttggtttaatttttaaggaaaattatctttatttagaagctataggaacgatatatgctaatcttatttctgcaattgttgtaccactgctgttatttagtattatttccagtattactaatctacaagcttctattaaattaaaaaaagtaagtttaaaaacaataatttacttattattaaatacatttactgctagtttaattacattgattcttgcagtaataacaagaataggtagtggatttaattatgaactttctacaaattataaggcaacagaagttccttcatttgtagatacaattactgggttatttcccaaaaatcttattaatagctggttaaatggggaagtagtaccaatagtaatttttgctattattgtagctattgcatataatagaatagttaataaagatcctaagaaagtaaaaccgtttaaacaatttattgatgcaggtaatcgggtattaggtgaagtagttaattttgtaataggttttacaccatatgcagtcttagctttgattgcccgagcagtaagtaagagtactatagatgatattattccattactaagtattttgggattagcatatttattgagcataattcaaatatttggggttgaaagcatattgttaaaagtaattggaaaactaaatcctattaaattttttaaaggaatatggccagctggagtagtagcgtttacatctcaaagtagtattggtacgattccggtaacaattcgtcaattagtgagtaaaattggtgtaaatgaagatattgcatcatttacagctagtttaggtgctaatttaggtatgcctggatgtgcaggtatatggccgacattattagcagtatttgcaattaatgttttaaatatagattattcaataggacaatatttatttttagtagtcttggcagtagttgtatctataggaacggtaggagttcctggaacagcaacgattacagcaacagcagtatttgcagcagctggtttaccaattgaaataattgtattgttagcaccgatttcaagtattgtagatatggctagaactgcaacaaatgttattggagcagcaaccgcagctacattagtagcaaaatctgaaaaagagttaaatatagatatttataatggaatatagcatattaattaaattcgtaactaagatttattagttatgaatttttaatatataagaaataaatcataataaggtagagatattcatatattgagatataaagccaaaaaacattattaaatatatataaaaacattgcataaagcggtataattagtattgtaatatgatgttgattgtgatatattgtaggaaagttgtaagatagaggcgcgaatagttatgaagtttttattggatgatgcaaactagataaaaatagaggaactttcgccgaagggataaatgattgcatgcatttatactctgggcttatagagaatatctataagactgtcattatcgaatggtaatggtgagctatcattgttcatacgtgtttatgttgcaatgatactcattgcaattttttttgtaaaggagagcaatgatggaaaagattattgaagcagtgagttatgaagaaaatattattcagttaaaattgacaaatgtaccaaaacatccaatgataattgccaagatttttacgattttaagcaattgtgatgttaatattgatatgatttctcaagtgatgattgaagatgcgatgcagatagaaataacattagatgaaaaatatcaaaaaaatttaaatgaagcaataatgtgtttaaaaaaagaagttaaacaattagagattgcgactaatcgaaaatattttaaaattgctgttggtggaaagttgatcgaagtcacaccaggagcagcggcaaaagtatttactattttaggtgaaaataatatacatttttatcaagtaactacgtcaaaaagaacaatttcgtttatcgttgataaaaaagacaaagatttagcaatgaaaaaattagatgaaacttttggcttaaatatataggaggaaattatggctatttttgaaggaagtgcagttgcactagtattaccaatgcatgaagacggaagtattgattatgatggatttaaaagacaagtacaaagaatgatcgatggaggtgttaaagctttattagttaatggaacaactggtgaaacagcaactattcatattgatgatgaatttaaattactagatattacattagaaatggcgcaaggaactggtataaaagttattgctggagcaggatctaatgatacagcaacagcattaagaaaagctaaatatgctaaagaaaaaggtgctgatgctattttagttgttacaccatattataataaaacaagtcaacgtgggttgattactcattatactactattgcagatgctgttgatattccaatgattctttataatgttccaggaagaacaggggtaaaaataaatgtagagacagttgtagaactagcaaagcataaaaatattgttgctatgaaagatgcaactgatgatatagcttatgcaatggaagttctagcaaaaactcaaggtatggattttgatatgtattcaggatgtgatgataatattctgccatttatttgtgctgggggaaaaggagtaatttcagtattatcaaacatttatcctcgtcaaactgaattattaactcagttagcactaaaaggtgacttgccaaaagctcaagaacttgcgtatgcattagaaccagttagtcgttacttatttgctgatattaatccaattatgcctaaagcagcattagctaaaatgggtgtttgtagagcgacattaagattaccattaattgaaacaacagaagaaaataaaaaactattatttgatgcgatggatgcatttgaaaaattggggttctaagatgaaagtaatagtatatggttatggattaatgggtaaaaaagttgctaataaggtaagaagccaaaatgatatggatctagtggctgttgtaagttatgagtttgatgaaaagattccagaaaaaagctataggtctttaacggagtgtggagaaaaagccgatgttatcatcgacttttctcaccctaataatttagatgacatattatcttatgctttgacaaataagacaaagttagtgattgcaacaacaggctataatgatgaacagctaacaaaaattaaagaagctgcaaaacaaattccgatttttcaatcatataacacatcatatggagtacaaatggtaaccaaaatattacgtcaagtggctaaagaattttatcaggcaggatatgatattgaaattcttgaaaaacatcataatcaaaaaatagatgcgccatcaggaactgctaaattactatatgaggtgatggaagaagaaattggtgaaactactgctgtgactgatcgaagttcattacatgaaaaaagaaagcatgaacaaattggtattcaagcaatgcgtggtggaacaatttttggtgaacatacagttatgtttgcaggaattgatgaaataattgaaataaagcacagtgctttatcaaaagaagtatttgtccaaggagcaattagtgctgcctatgcattaattgataaagataatggtctttatacattgaagtcattgtattaattagggggatattatggtattacaaacaaagtttgcacaaataaaaaacaataatctatacatagatgatgttaaagcaactgatttagttaataaatatggaacaccactttatgttatgagtgagggacatattagacatcaatttaatgaacttaaaacaaaaatgatagacaaatatgaaaatactttgccactatttgcttcaaaatcattttcatgtttggctatttataaagttgcaaaagaatatggggtaggtattgattgtgtttcagctggtgaaatatctgttgctctaaaagcgggatttgatccaaagaaaatctattttcatggaaacaataaactaccttcagaaatagaatatgctttaagtaatggtgtagaaaatttaattattgataattttcacgaaattgaaattgtacaagaaatagcgcaaagattaaatgtcgttgttaacggtgttgtaagaataacaccaggagtatatgcaggaggtcatgactatattcgagtaggagcaaaagatactaaatttggatttagcagtcatgacaatacatatttaaaagccataaaaaaagtaattgatgctccaaatattaattttgatggaatacattgccatgttggaagtcaaattgaggatattcaggcttatatattagcaatgaataaatttgttgatatttcatatgaaatttatgatatatttggaatagttataaataaattaaatgccggtggaggatttgggatagcttatacaaaagcagataaacctttagagtttgaaactgttgttgatacaattatggatataatagctaaaggatttgaagctcgaggattaaaaagaccaatggttttagtagaaccaggacgttattgtgttggaaacgcaggaataactttatatactgttggttcatctaagtatataaaagatattcgagattatattagtgtagatggtggaatgacagataacattcgctctagtttatatgcagcaaaatatgatgcaattattgcaaataaagcagagatgccagcagatcatttaattacagtagcaggaaaaaattgtgaatctggagatattttaattaaggatattatgttgcaagatccagaaccaggagatattctagcaatgttttctactggagcttatcattattcaatgtcatctaattataatcagttaccaaaaccagctgtagtatttacatataaaggtaaatctcgcgaagtgatccgtcgacaaaccttcgatgacttagtatattatgatattgattcaacgtactaataaagcggcatgggccgcttttaatacttaatagaattaaagtatgcatgatatcaaatagatatttcgatgttattaaaaggaggggaataatatgaaagtattaattatagatgatgatcttgtttttggtaaaaagttaggaaatcttattaatgaaaagtttggtaatgagaaaaatgatatcgtgattaagatcaatgtatctagcatagatttaaagcaaaaatttgattattattttatagatattatgctggagggtgaaaacggtataaattgtggtaaaatgattattgataagaattattttgctaaaataatatatatgtcttctgaagaaagtttagtttatgacacatttgcaagtaaagtttattttttcataagaaaagaaaatttaaaacatgatttagaaagattatggataaaaataaatcaagataatgtaaagaatactgattatattgaaattatttctgatcgtaaaagacaaatgattttaaagaaagagattatttatattgaatctaatagaaataaatgtcagatctatatgataaaagagcaatatgaagtatatagaacattaaaatcatttttaaatgaattagattctaatcaatattttcgattaaacagttatacgattataaatttagaatatgtaaaaagtgtaagtggtaaagaaatagtattaataaatggcgaatcatttgttttaaaaagaaattataatgattttattgatgcatatcataataattatatgaagaggtttaaagaatgataataaatattgtagaatcgttaatagctgcctatttctttacaaattattttgacttaaaaataaataaacgaatttattatatactaaattttattcccatttgtttagagataaatattgtaaattcatatattgtttcaagtatacttctaccattattagttgcacttactgcaacacttaatgcatactattttacaaaaaataatctttgggaaatattatttattacgttttttgatgaattaatagtaggattatcaattacgatttcattattaacagaggaatttgttgttccagaactaagaacaattattgctaaaattttgtactttttaattgtatatctagttatatacgtatataaatcaaaagaaataaaattaaatcctatatattggaaattattaactattgttgctgttgtattttattttgcatacgcaatattgttgcaattttatttaggaatgaaattaagtcaacatttaatattcataactttactatcactaggtttatctgtaataggaatagctgtaatggtttactatatttctaaattagaacgtgaaaagcaggagactcaattttcattacaaaagttagaaatggaacaaagtaattataaacagttaaatgaagtttcaaaagaaataaagataatgcgtcatgatttaaaacatgattatttattgattgaaaattatttagaagaaaataaatattctgaaataaaagaaatgataaattcaagggtatatgatttagaagaggtgactcatacggttaatagtgagaataagttgataaatacaattattaattataaaaagatgatagcacaaagtaaaaatattaaggtcaaatataaaataaatgtcagtggtagatcgtatatgaaagattatcatttaaatgagttattatctaatttattagataatgcgattgaaaattgctctaaaaacaattctcaaatcgatatagttattgaagaagatgtatttttatatatagaagttgttaatcagatagataaatcagtcttagaaaataatcctaatttacatactagtaaaattggtgaaaatcatggtcacgggataaagagtattcaaagaattgtaaatgaatatggtggtagtattaaattctttgaaaaagatttagaatttcatgtttcaataataattccgataaatcatcctcgttaaaatgcgtttcgtcccatgtttatttaaatttgtcgaaaaataatttattatggctattgaggaggtgaaatgattggtacaaggtatatcaaaatggttattaaagatatataaaaacaagaccgttttgaattatgatgatgagatatttttatatgggattgaagtaatagctacatctttacttaatgtattattgttgttatttattgggataataagtgggacagtcaatcaagcattggtttatttcgtgtcctatgcaaccctacgaaaatttattggtggatatcattgcaatactaattttaattgcattacatttaatgtttccaaatatatactctttatatggctttacccacatgtagagatcaacaaactactgatgatatctataattataataacactgatattaataatatggggagcaccttttgaacacagaaatagaccgataagcgaaaatgaacggtacaagtataaaaaatattcttttattattacttcaatttatgcggtgtttattttattgtctagtgaattttatcatgttctattatatgttttaattgtaattgacttgtcatcaataccttgtattatagaaagtaatggaaaaagttttaaaaatgtttagtaaactagttctagtagcttctaccggtgccgtaagcggcgcatctcggtggagtgattatcaaccaaaagaatcagaagctttaaagaaattaaaaaagttttaattgggagaactttctaaaatcatttgttttctcaaatgcatagctaaaaactaaaattattgaatatttataataaatagtataagatgtagcgcaatgattttagttatggagtaaagaagttagatgtttattttgtttttcctgttttatttaatctagttattgagaaaaacatatattgcagctaacttttttattatattattttataaaccaaggaagatttgtaatcttcctttttacgtattatatctttttctttggtttattaagctcttcatgaatcccctgcattttataatctagatgggatattgttttagcacaatcaattaattcatcacgaacgccatcaggaacttcgttatcagctttgtatcgtaagtgatgttctaaactagcccaaaaatccattgcaatagttctaatctgaatttctacgggaataggttgtactttttcagctaaaaatattggtatttcaacaaccaaatgtaaacttcgataaccattttcttttggatgttttatataatcctttttcttaattaatttaatatcactttgcttgataagtaaatcagcaattttataaacatcactaacataattacaaattactctaacaccagctatatctgttaaattaattacaattgactctagagagacttctaagcctcttttttctagtttaccaagaatactttttaccgattttaatcgatactccatatgatgaataggattatgatcatgtttaactctaaactcatcatcaagaatttctaatttagttcttacttctttaataccagcatcataaacttgttgtaaagttaaaaattcttgcagtgtgtctgttatttcttcatccatgtttattgatgaaaaaggatcactaattatttctttttgcatgattctttctgccataaaaaatacctcttataaataattttttgtatactttaatcatagttggtaataatgaacttgaggtgaactgatatgaaaaaaacaattattatagtattaattttaatgaatgtagtaactgtcaatgcttcaagtaatgatcctaaatataaaataattgctaatagtaatagtgaaagtgatattaaagaaatgtataaaataaaagataacttaataagtgattatcgtaagtggatcaagggtgttgatgatattgatcaggtattagctgatcatcaaaaagattatgaggctagctattataacggtgaatataaaattattattggtaaaggtaaaggtaaatctcttactggtacattaaaagcaagttattgtactagtagtaaagagataaaaaagaaatcattttttgcggaacttttttcataagaggcagcatgtggcctcttttattatatgtaaatataaatcatcttatatgagatggttttatgtttaaaataaagtgattcgttaataatttaaagtgttaaacatataataaaattagaggtgaaccatgttaacaaaatttgatgaacaagcccaaaaagcaattgttgtaggtgaaagtattgcttttgatttaggtcataataatgttgggagtgagcatttattattgtcattattaaaaatcagcgactcaaaattaaaggagctggtaaagaaatataatgttgatgataaaagtatatatgaggatataaaaaggttgtttgggacaaataatgatcaacctttttatatggaatatagtgatgctgttaaaaatattttagaaacagcagtcaacattacaaatgaacaaaataaaagtaaagtcactttaaatattttaactatagcattattgaaaagtgaagaaagtgttgcttatgagttgttaaaaaaatataaagttgattttgaagatattatttataaattgaatgaaagtagtgaattagaaacaaaattagatcaaattcaatcactgattaacctcaacaaaaaggtaaagaagggcggaaatttaattgttggaagacaaaaagaattagaaaaactttgtatgattttaagtaaacgggaaaaaaataatgctcttattattggtgaagcaggggtcggaaaatcagccttagttgaaaaattagcgtatttgattaatgaaaaacaagtaaacgatggattaaagaaaaaaattatttatgagctaagtttgtctagtattgttgccggaactaaatatcgtggcgaatttgaagaaaaattgagaaaaataattgataaagtaaaagagatggataatgtcattatttttattgatgaaattcataatataattggtgcaggtggagcagagggagcaatagatgctgctaatattttaaaaccatatttagctagaaaagatctaacgattattggtgcaactactacagaagaatattatcagcactttgaaaaagatcaggcaatgaatcgtcgttttagcatagttactttaaaagaaaatactaaagaagaaacatttgatattttaaaagaaacaaaattattttatgaacaatttcataagattgaaattgatgatgaagttttaagatatttagttgataatgttgatcactatattaaaaatagaacatttcctgataaggcaattgatatttttgatttagcgtgtgtaaaaacaaggtttcgacaacagcatattatcacaaaacaaatagtaaaagatgtaatcgaagaatatacctctattaaaattagtgataattatgattatgatgaaattaaagtaaaattaaataatcaagttattggccaaaatgaagcgattgaacaaataattagccaattaaaaataaataaaccttcaaatcagcctacagccataatgctatttactggtagtagtggggtaggtaaaagtgaaatggccaagcagttggcaaaatatttatcacgaaatctaattcgtttagatatgagcgaatataaagatagttctagtgttcaaaaaattattggtgctgcgccaggatatgttggttatgataaacctagtttattattaggacaattacaaacgtatcccaagagtgtagttttattggatgaaatcgataaagcaagtcaagatgttattaatttatttatgcaagtgtttgatgaaggctatttagaagatagtcataaaagaaaagtttattttaataacacgattattattatgacttcaaatcaaggtagtaccaaaaataaattaggatttaaaaagaatataacaaacaaaaaatgtaattatggatttagtgatgaattattgagtagggttgatgaaataattaatttcaaaaatctcacaaaaacagatttaaagaaaattattagaaaaaatataccacatgaagttaaagaagaagatattcaaaatatattgaaagattatgatatgaagctacaagggcgtggaattataaagaaggcaaataaatattttcaaagtaaagctaaagcataaaaacttagactagtgtctaagtttttttacgctttgtcttcttaataattagaataattaaaaatagaatactaataatcaatgcatattgcttaacatatttatgaattttgatccagttatttcctaataatattcctaaatatactaggataccattccaaataatcgttcctagtaaagtataaaaagagaaacaaaaaaagttcatttttgttattcctgccggcaatgatattatagaacggataataggaattaaacgccccgcaaaaatggaaagtttaccgtattgtttaaaccatctaatggagttttcgagagaattaggcttaaaatgaaaataaattaagatttgttctagtatgttgattttaattaaataacccataaaataaagaataacagatcctaaatatgaacctaaagtagcaacaattaccactccaacaggttgtaatgaggttatagtagttaaaaaacctccaaaagttaaaattatttcacatggaatgggtggaaagatgttttctaaagtaattaggataaaaatagctttgtagccataactgctaattagggcaagaatacttgctagcattatatgtctcctttcgagataaagggagtattttgtaagctaaatgaattaacatattatcaaatggtaataagataatagttgaaattatattaaaaaatgtatgcatatatgctatttgcatcatataatttggggttaaagagtgtataaaatcaataaatggaataaaatatgatgcaataaaaaaaacaatagtaccaattatatttattagtatatgaatgatagtaagacgcttagaattaggatcaccatttatggaagctaataaagcagttatacaggtaccaatattttgcccataaataacatttgttgccatagtaaagttaattaagcctttttgatatattgtttgtaagacccctacggatgctgtagaactttgaatgattgcagtaaaaatagttcccacgattatagctgtaataggattatttaattttgcaaacagctcaataaaataagatgaactttgaagcggaataagggcaattgccattgcatccatggctaaaaaaatcaatcctagagccatgatcacgcgtcctatatacattaatttattttttaataacatcaaaaccaaccctataccacaaaaataaattgctgattgtcctaaatctaatgcaatcaacagccctgtaacagtagtaccaatatttgctccaagaatgatccaggtagcttgattcaaagtaataagatgactatttagtaagccaatcaaaattactgtagttgctgaggaactatgaataacggcagtaatcgcagttccaatcaatacaccaagatatttattagaagttaatttataaagaatattttttaatctgttagttgctaagatatctaaactagaagacatcaggtgcattccatacaagaaaacaataagacttagaataaagccaacgatatttttaataataagatcacttccttatttaagtatattattaaatatgtaaataatgtttattttcaagataatgattaaatgctacaataagaaaaaagaggaagtgagataatgaattatagtgcagttgtgttatgtgctggtaagggcagtagaagtggcttgagttataataaaatgttatatcgttttaaagataaaacagtctatgaaatgacgatggaaatatttttaaatgatgatagatgtaaacaaattgttgttgtaaccaaagaagatgaaattagtgatttaaaaaaactcatctcatctagtaaaatagattatacttttgggggaaaagagcgccaagatagtgtttataatggtttacaaattgtaaatcaggaatatgttttgattcatgatggggctagaccatatttaaaaaaagaaaatatagatgatttattactttgtttaaataataatgatgcttgtttattgatggttcctgtaaaagatactataaaaatgtgtaaagatggaaatgttatagaaacattgcctagagaaactttgatgcaagctcaaacacctcaagcttttaaaacaagcataattaaagattgttacaaactgggaaaaattaataattttgtagctactgacgatgcttctttggtagaacattttaaagtggctcctgtaaaagttgtgataggaagttatgaaaatattaagataactacacccgatgatttataagataccaatttaggtatcttttttttcaaaaaattatttttacttattgacgaaagtaataatatgtgctaatgtattaaacatagtattcctatatattaagtaggaataagaaaggagatacgaaaatgaacactgcaagtaaaatgaaccaaaatatgatgtgtatgtgtagctgtatacaaatgtatagagtatgttttcgtgtatgcaaatattcttaatctttaattttattaaattctagaatgaggatgttcgctatgaacatcttttttattaacatagggggaagaaaaatgaaaaaagatttattacaaatagagttggaaacccaatttaaatggtttcacgctcatccagaattatcttatcaagaatatgaaacaacttcgcgattgaaaaaattgctgaaagagcatgatattgaaattttagatctgccattagatacagggctggtagcaataattaggggaaaatatcctggaccagtaattgcgctaagaagtgatattgatgctcttccggttaatgaagaaactgatctacagtggcgttctaaatctgagggtaaaatgcatgcctgtggtcatgattttcatcttacgacaatttatggaactgcattattattaaagaagcaggaagaaaatattcatggaacagtaaaattaatttttcaacctgcagaagaatcttcactaggagctttgaaaattattgaatcaaaagctctcgatgatgtagaggcgatttttggaattcatagttcatcagtatttccagttggaacattgggtataaaagcaggaagtattactgctgcagtagatcggtttgaaattaaattaaaaggatttggtactcatgcagcacatccacagcaaggaaaagatccaattgtagctttaggggctttgataaatgctatacaaacgatagttagtcgtaataccgatccgttatcaagtggtgttgttagtattactcatgttgaagcagggaagacatggaatgtaattcctgaaacagcatttttagaagggacaattagaacattagaattaaatgaccgaaaactttatgaagaacgtttaagagaaatagtagagtatataggaaaagcatatcaaattgatacagaagttaaatggatagcaggaccaggggctgtaatcaatgataaagagtggagtgattttgcaaaagaagtagctaaggaagatgacattaatgtagcttcaagtgcagtttcgcttggtggtgaggattttgctttttacctagagaaaatcaaagggacatttattcaaattggaacaggtgagacatatcctaatcaccatccaaaatttcaggttgatcctaaagctttatcattagcagcagaatatatgagtcaattagcagttaaagccttattaaaaatagaagcaggggaggaatagtgatgattcaaatagaacatgtttctaaaacttttcatactcgttttgaagaggttcatgcgctacaagatgtttctatcaaagtagaaaaaggggatatatttggtgtaattggttattctggggctggaaagtcaacattgattagaatggtaaatttattagaaaaaccggatcaaggaaatgtttttattgaaggtaaaaatattacagattattcatcaaaaaaattaaatagattaagaaaagaaatagggatggtttttcaacaatttaatttattagaaagtcaaacagtttttcaaaatattgctattcccttgattttagcaaaatataataaacaagatataaagaaaagagtatacgaactattagatttcgtaggtctaaaggataaaagtgatgtttatgtttcacaattatctggaggtcagaaacagagaattggaatagcacgagctttagctactaatcctaaaattttgttatgtgatgaagcaactagtgcattagatccagaaacgacagaatcaatcttgttattgttaaaaaaaataaatattgaattaaatattactattttattaatcactcatgaaatgaatgttattaaaaaaatttgtaataaagtagctgtgatggaaaatggaaaaatctgtgaacaaggggatacaataaaactttttagcaatccgcaacaggaaataactaaaaagtttgttaaaaccgtaatcaacagttcgatatcagaaacaattctaagaaacttagattatgctgatccaattgttaaattaactttttttggagaaaattcacaggattctgtagtttcacaaattaataaacagtttaatgttacaacgaccattttgtttgcatcagttaatgaaattcaaaatacggttttaggaatcctaatcttacaattacaaggaaataaaaacgaaattgataaagcagaaaaatatgtaattaaaaggggaattgctattgaaagggtggtgactacaaatgagcgataatctattaaatgttggatcagataaactaatagattgtgcagttcagacaatctatatgctgggctgggctctgttttttggaacaataattggaataccattagccttagttttagttttaacacgtaaagatggactaaggagtaatcggataatctatgggatcatcaacggtattgtaaatttagttcgttcagtaccatttgttattttattagtatttattactcctttaaccaaatcattagtaggaacaagaataggaaccaaagctgctatcgttccattagttttctatattgcaccatatttagcacgattaattgaaagttcaatacttgaagttaaaccaggaattttagaagcagctacagcattaggagcaaatacttttgaaataatttggtactttttattgccagaggctaaggcttcacttgttcttgcgataactaccggtactattggattacttggggctacagcaatggcaggtactattgggggtggtggtataggtgatttagcactaacctatggttatcaacgttttaataatgaattaatggtagtaacagtaatcatattgattatatttgtgcagttgattcaaacattaggaaattatatatcaaaaaaattaagaacacataaataaatttagggggaagaaaaatgttaaagaaaataatttcagtttttacagtattagttttaggatttgtttttactgcttgtggttcaaatcaaacaagtaacgatgaaaacaaaacaacgattcgttatggtaaagctgcaggaccgtatacagttttattcgaagatgcgataattccaattttagaaaaacaaggatataagtttgaagtagtcgagttttcagacttattacaaaacgatattgcgttaaatgaaggtgaaatcgatgttaatgttgaacagcatacagcatatatgaataattttaatgagtcacaagatggagaattagttgctttgggcgctattccaactgttccagcgggaattttttctaaaacacataaagatttaaatgaaatagaaaaaggagctaaaatagctgtgccaaatgatgcagccaatacagctcgtgcatatgctttactacaaaaagcgggctggatagagttagatccaagtaaagatatttctacagtaacgcaaaatgatataactaaaaatttatatgatataaaatttactgaaatggattctacaatgattccacaatcattagatgaatttgattatgctgtaatcacgggatcaatcgtctataatgctaaaatcgatccatcaactgcattgttacaagaagatatcttagatcacttgttacttcaagttgtagtaagaaaagataataaagatagtaaatgggcaaaagatattgttaaagcatatcaatctgatgaatttaaagagtatttagataaaaataatgatggtttatggtatgttccagaatataattaattgttggaggcgagatatatgcataaaatagaaactaaatgtattcatggagaggagtctgattgtttaactaaatcatatggagctgttgctgttcctatttatcaaaccgcaatgttttctcatccaggaattggtcaaaatcaaggatatgattattcaagagaaagtaatcctactagaagttatttagaagatattataaaaacactagaaggcgctgtagatacagttgcctgttctagtgggatgtcagcaatttctatctgtttatcattgtttgatcctggagatcatattatttgtggtgatgatttatatggtggatcagtaagaatgtttaatttttataatcattttggtctagaattttcatatgtaaatacagcagatactaatgcaattgaaaaagcaattaaaccacaaactcgtgctatatatattgaaactccaagtaatcctttaatgaaaattagtgatttaagaaaaattggacaaatagctaaacaaaataatttacttttaattgttgataatacatttttatcaccttatttacaaacaccattagagttgggagcagatatagtaattcatagtggtacaaaatttttaagtggtcataatgatgttattgctggagtgatttctacttctagtgataaacttgcaaaaaaaataagagaaatatacaaaactaaagggtgttgtttatcaccgtttgatagttatttattaattagaggtataaaaacactagcaattcgtcaagatcgccaacaagaaaatgctactaaaattgctgactggttatctcgccaaaaaaagattacacaagtttattacccaggactaaaaacacatccaggatatgagataaataaatcacaggctagaggagcaggaagtatgatttcatttagagttgattcatcaagtactgcccgtagaattttagaaaatgtaaaagttattacctatgctgaaagcttaggaggagtagaaactttgataacttatccgatgattcaaacacatagcgatgttcctgaagaaataaggcaagagttgggaataacagatgactttttaagattatcagtaggaattgaaaatatcgatgatttacttgcagatttatctcaagcaataggggaatagtgatggtttataattttgatcgagtaattgaaagaaaaaatacattatctttaaaatatgatttttcaaaagaacgtggaaaaccagaagacattttacctctttgggtggctgacatggattttatgacgacaaatgaagtaattagtgagttaaaaaaatatgtagaattaggtgtttatggttatagtgaaagtaaagaagattattttaaagttattcaaaattggtatcaaagatattttcaatggcatttggaaccttcctggctaatcaaaactccaggagtcgtatttgcgatttcagcagctattagagcttatactaaagaaaatgatagcatcattattcaaacaccagtatattatcctttttatgaagttatattagataataaacgtaatttagtaaccaatccattattattgaagaatgatcattatgaaattgattttatagattttgaaagaaagattattgaaaataatgtaaaattgtttattttgtgcagtcctcataatccagttggaagagtatggcgtaaagatgaattgattaatttaggtaatatatgtttaaagcataatgtaaaagtaataagtgacgagattcattgtgattttacttatccagggcataaacactatgtatttgcttcattagatccacaatttttaatgaatacagtaacatgtacttctccaagcaaaacatttaatcttgctggattgcaagtttctaatatatttattccaaatttaaaaatgaaaaaaaagtttgaaaaagctgttgctcaaacgggatatagccaattaaatttatttggtttagttgcatgtaaagcagcttatgaatttggagatatttggcttaaggaattaaaattatatttgattcaaaatcttgattatattaggaattttttgaaaaatgagttaccattagtaagtttaattgaacctgaaggaacttatttggtttggcttgattttcgtaaattaaacctatcagaagaaaagttagaaaaattaattgttgaaaaagcaggattatggttagatagtggtaaaatgtttggtattgaaggagttggttttcagcggataaatatagcatgtccaatatcaattttagaaaaagcgttatttaaattaaaagaagcgttattgagttaattatattatttaagattatgaatcttatttgatattgatagattattaataataaaaaagggcagtaataaaattataaaaaaagcatagaatttaattttataaatatgtgatttccatgaaaataagattttatcaatattcataggcaataattaagtattcgccggagtacaatattaatacgtattagaaaaaaatatgattatttggttgatatgatgacctttcagtagatagcgtaaataattaaatgctgatacgggaggttttttatattgagaagaaaaagtaaatgttaaaaaaaactaagattaagtgttgtaaaaagatatttagatggtgaagaatcaactgtttctttagctaaagaaataaatacaaacaaatgatgtagtggacaattggataaaaaatatcagacatttggtgaaagtgcatttgatacatctgctacaaatacatcttatacaaagaattttaaagaacagatagtattggattatctcaatggtggaggttcatataatgatttggtaacaaaatatcatgtttcattacacaagtagttcaactttaactgcataaagaaaatgaagttgtctcatcgacaacttcatcaaaaacattttaattatttcacctgtctatttgacaggggtgattcattattcaaggttttctagtatcaattaatcaccaatgtatgataacatttattttataagtgttaatttcattgatttttagtcgatttattacactattttcaagaatttccagctattattttgatttctttcattttttgatgtcaaaatgatgtcaccatataaatcaatatctctcatataatctcgactaaatctcgactaaatctcgactaacttactcttttaaaatccaagaggttctatctttggaatctgtctttatatcaccattttttctcaaagaagctaataaatttccaatttttctttctttttgattattatttaatatatctggtaatttgtcccaaagcaatattcttaaatcttttttctttgctctttgatattcttttaaataattaataatcaaatctttataatactgatcatcaaacgctttattctttatatactcagcttcatgatctatactctttgatattgaagcagataaatataaattagatattcttccctcaactaattttagttttctaagatacgatactctttcttttgaaatttctaatcctttttgaactctgtctaataaaaatactgtttctaaatctaattcaggatgcgcatataatatatgcatatattcatcatttaagacctttccgtatactgttacagacacttgattataagtattgaaatcataatctggtaagggaaaatatttatctttttgtattttaaatacttttcttattcccatagttgcagtatctatcatatgaaattttaccatagtttcagctaataattgatttctatagaatggtggattttaactaacctgtaaaaccgtttctatattttgaggtataaaatctcctggatttgttattttgatttgatcttcaaattcattaatatatattcttccacctaattgaaaattagaatgtgctaagcagttattaagtagctctcttaaaagccaagtatcatactactgtgtttctattggaaataatgtaagttgatttggtatatagcgatatgttaaatttcttatctttgaaaatattttatcaataacatttataaagggaattgtaaaaatttcataatcttttacttctccctgacttccatatagtcgccacataagtgttggaggtctagaaatcaaataatcataatctgaatgacctaataataacatagcagcattggtaacttttccatcatataataatttcatttttgttaaaaattctaaatcatccatattgtctatttcttcaacaatatgttttttatccattttttctttatattttgatcttgcaatttgaatagcatccttatctaagtggttaatagaagcacctttaacaatttgtttcgaccaatctaatcgttcttgtgaacgaatttcatcaattttgtattgctgtaaagatataagactttcaccagatcttgcataataatggtttttccaacttgtaggaaaacctgttactgcagcaggaattttaaacataagaactctatattctttttcattaacaattggttttaattcaatgatttcaataaaactaatattatcattagtacttttagatatttcatacttaaatttttctagtaaacctaatccatttttaaaatttgtaccaactattcttttgttatgatcttcactaattccaaagatcaaccatccatattgttgtctttttaaattagcttcattacttattgctgaaaaatattgcccaattttattagtatcatattgtccttttgcttctttaaattctacaatttcattttcccaatgaatcatcaattccataagaatctcataatactgtgctaataaaccagatttatcataattaaaagttttcacgattttacctcctttcctagattaatatattataccaaataaaaaaataagttaaaactgctttatcaattttacaataaattctttattactcataaattatcaagacatctcaagaaaagaaaaaaccttgaataatcaaggtttttaagtatcgattaatcaccaacgtatggtaataaagccatttgacgagcacgtttaatagcagttgctaacattctttgatatttagcactagttcctgttacacgtcttggaataatttttccattagctgaaacgaatctttttaataattcaacatctttataatcaatataagtaatgttattttttgtaaaataacaaactttttttctacccattctttgttttctaaatgccatttttttagctcctttcattaaaattgaatatcatcttccataatatcatatgtatttagtgagttatcaaattctttttccaattcaacagttttcatatcataaaaattatcattactttgtggctgttgcatttggacttgagattgtgccctttcacgtgccgcttttgtctctaagaactgaacactatcacatataacttctacaacatatactttttgtccttgagcattgtcgtagcttcgtgtctggattcttccttcaacaccaactaaactacctttagaacaatatctttctacattctcagctggtttacgccaaacaacacaattgataaaatcagtttgttgctgaccgtctcttgatgtatagttacgatttacagctagtgtaaatgatgtaacagcatcaccttgaccagttctcctaagttctggatctctagtcatccgaccaactaagactactctatttatcatttagcgacctcctattatttacgaagagttaaatgacgtaacatagatgaattaatatttgataaacgttcaaattcagcaacatctgcagctgtacatgttgtatcaacaactacataatatccttttttaaaatcttggatttcataagctaaatcacgtaatccccattcgtcaacgttatcaacagttccaccgttagctgttaagattcctttaaagctttcgattaatttgtttctagcgtcttcttcaacgtcaggttttacaataaacataatttcatacttgttcatttttatacctcctatggtctattggcttattttataaaataagcaggcagtaaataaaatattttacatgcttatttatgatagcatattaattaatttaaagcaataacttttttcttaacaatattcgtagtgtaataacgttttaatatttcctcggtaataaaaagtcaattaaatttaatgatttatagttttaattgtcatctttatagaaactagaattctttaaatttataactgaattaatttttcatattaaattaatgagaacaatatcattaaaagcttctatttatctattgtcatagattccatactattaaatgcagcgtcacttagcattcttatttttttccaatcatgaatattactattatcagcgactgcccacactataaaaccagctttttttgctgaacaaatagcatgtagagcatcttcaattacaatacattcattaatattcagatcaagtgatttagctgcaaattgataaatagtactatcctgcttggttaatacagtatcatcacaagtaataatactattaaaatagtgtaataaattattttttgttaaaactttaactgttaaatcatgtttgttagcagttagtaaacataattttttatttgatgcaacgcagtttttaataaaattttttgcaccaggctttagtgttgcgttatttaaatattgatattctaaaatttttaataattcattttgaagttcaggtattgtatttgataagtggtatcgtttttttagatattttaatgcttcgtctatagataatggagctaatatatttttaagttcatcatcaaaagtaattccatttttttgtaataacatcattacaatattatcccaaataaacatagaatcgagaagtgtaccatccatatcaataatataacctttaatcattatctaatctcctattaattttgtatatttgctgttttttctaatgtaaaagcagcttttgggattattatagagcattatatttagagtatcaattgaataatttttattattgttttgattaattgataaaattgaaaagaagcagtaatttatgttattaaatatgtaaatatatcggcaagttttattgtttagaaaaaagtttttgggctactatattaataatttacttctagtttataatctaatatcttattttgatagatagttatataaataggcaaaacttgaagttagaaataattgcattaatacaggtgatagagtataattaataaggtttgtgaaaaaatctagaatggagcgataaaatgaaggaaaattatgatgttgtggtagttggagcaggaccggcaggaatcatggcatgttatgaattgtatttaaaacaaccaaaattaaatgtgttgcttatagataaaggacaggatgttatgaatcgtcgttgtccaattaaagaaaagaaaattaaatcatgtccaattattaaggataatgagcctggatgtttaccggcttgttcaattacagcgggatttggtggcgctggagcatattcagatgggaaatttaatattacaagtgaatttggaggctggttgacagattatctttcaactgatgaagttgaagaggtaataaattacgtcgataatttatacctaaaacatggagctacaaaagatataacagatccaacaacagataaagtgaaagaaatagaacatcgcggttatgcagttgggttaaaattattaagagctaaagtaagacatttaggaactgaggaaaatcttcgtattatgacagaaatgtcgaatgaattaaaacagcatattgatatattgtttaaaacagcagtaaaagaagtggtggtaaataacaatcatgcaactggagtcgttttagaaaatggaaatattattaacgctaaaaaaattgttttagctccaggacgtgatggttcagcctggttgactaaagtattaaaacaacatgatattgaattatataacaatcaggttgatataggggtacgtgtcgaaactagtaatatcgtaatggaagagatcaataataacctatatgaaggaaaatttatttataatacaactgtaggaactagagtgagaactttttgctcaaatccatccggacatgtcgtaatcgaaaaccatagtgggacaatgttagcaaatggacatgcttatcatgatcctaaacttggtagtaaaaatacaaattttgcattactagtatcacatacttttagtgaaccatttaatcaacctaatgaatttgctcatgaagtaagtcggttggctaataaattatctaatggcagtgttattgttcaaaggtatggtgatattaaaagaggacggcggacaacttataaaagattaaaagaaggatatacagtgccaactttatctgaagcagtacctggagatttaggattagtactgccatacaatacgatgaaatcaattatagaaatgatagaggctttagatactgtaactccaggaattgctaatgagcataccttattatatggggttgaagcaaaattttattctgctcgtcctaaggtaagaaaaggttttgaatgtgaaattgatgatttgtatgtagctggtgatggtgccggattgactagaggattagcgcaggctggagctaatggaattattgttgcgcgtcatattattgaacaacttgaaaagtaataaagatcctgtttgatacaggatttttatatacaaaattttataatttattttggcaaacagtgtatgtttatgagataatagatatataaataattatactatttgtattaaatattatatgggaaaggaagatattatgagaaaaattagtatgattttagtatgtctaggtttatgtctagggttatttggttgtagtaatgatagtggcaaagacacatctaaaaaaacggaggaaaaagaatttattacagaggaccaattagatagtttgtatttaaatcctgataaatttaaggggaaatatgtaaagttaacaggacaggtatttggaaatatagaaagtgaagatgatacaacggtatttcaaatgatgggagatccagaagaatatgaaaagaatacaattatacactgtaagaagtcattagcaaaagatttaaaatcagatagttatgtaattgtaaccggtcttattaaaggaacttttgaagggacgaatgcttttggtggatcaataacagcaccacaaatagaagctgagaaaattgaaattagtagttatattgatgtagtttctccaactttaaaatctgtagagatcaatgacgttagaacatctaatggggttacagtaacattacaaaaagtagaattttcaccatttgaaacgagagtatatatatcagttgataaccaatcagctaatgaatatagtttttatttatatagtgcaaaggtagtccaaaatagcaaacaatttgaatatgaatcaaattactatgcagattatcctgaagtgaatagtgatattttagcaggtgttaaaactgaagggatacttgtgtatcaaggattagaacaagctgattttcaattagtatgtaaaggacaaagtgatgattattatcttgatggagatacatttacttttgatataacagttaattaagtattatataggctattttattgagtagcctattttttattattgacagattattaaaagttaagtatacttatatcatactaatgaagtaggaaaaggtgataatatgagctttgaattagaaaaacagcttagaaataattttagaaatggacgaatgtattgttgttttaaattataaaatattatgcataaagaaaaggggaaataaaaatgagcaaaaataatttaagatttgaaacaaaacaattacatgtaggacaagagacaacagattctacaggagcaagagctgtaccgatttatcaaactgcagcttatgtatttgataactgtgatcatgctgcagcacgatttggattaagtgatgctggtaatatttatggacgattaacgaatccaactgaagatgtttttgaacaaagaatagcagcgttagaaggtggggtagcagctttggcgttagcatctggagcagcagctgtaacatatgcaatagagagtattactcgtgcaggtgatcatatcgtggcagctaaacagatatatggaggaacatataatttattagcgcatactttaacaaattatggagttaatacaacttttgttgatggcgatgatcctgagaattttaaaaaagcattgcaagaaaatactaaagcaatttttattgaatcattaggaaatcctaattcaagcttgattgatgttgaggcgattagtaaaattgcccatgattttaaaataccattaatcattgataatacatttggaacaccatatttatttagaccaattgaatatggtgcagatattgtagttcattctgcaactaagtttattggcgggcatggtacgactttaggtggaattattgtggattctggtaaatttgattgggaagcatcaggtaaatttccacagcttacacaaccagatccaagttatcatggtgtggtttttacaaaagctgttggagctgcagcttttgtaacaagaattagagctgtcttattaagagatacaggggctactatttcgccatttaacgcctttctactattgcaaggtttagagacattatcattaagagttgaaagacatgtagaaaatgctttgaaagttgttgattatttaagtaaacatccaaaagttgctaaagtaaatcacccatcattaagtactagtccttatcatgatttatatcaaaagtattttcctaaaggtgcaggatcaattttcacttttgaaattgctggtgatgaaaatgatgctaagaaatttattgataatttagaaatattttcattgttagctaatgttgctgatgctaaatcactagtaattcatcctgcttcgacaacacattcacagatgaatgaagccgagttggctgattcaggaattaaaccaacgacaattcgcttatcaattggtttagaacatattgatgatttattagaagatattgaaaatgcttttaagtatgtttaaaaaattgataattaataacaagctatccctagggatagcttttaaattattattaaagtataattatattgaggtgatttttgatgagtgaatttacaaaaataccgtatgttggaaaagctacagaggcatctttaaagctgattggttataaaacattggattcattaaaaggagctaatcctgaacaaatgtatcaaaaagagtgtgaaatcaggggtgtacatgttgatcggtgtcaattatatatgtatcgtatgattgtatattatgctaatacaaaaaatcctgattctaaaaaattaaaatggtggtattggaaagattgatattgacaagattggtttgataagttaagattacaacgataaataaaggcgatgaatagaggagtaattatattttatgcattaaagagagtctcggctggtgaaaagagatatgatgagtataatgaaaaaagactaggagctgtatctaggattaagattgattagataacgtgagccacgttacaggcaaagctattagatgatagctattgaggttaataaggtgacttattaatgaattagggtggtaccacgatgactttcgtcccttagggatgagagttttttatattttaggaggtaaaaatggaagaaagaaaatttagtgaacaagaattggttcgtcgtgaaaaattacaagaattaattgataaaggaattgatccttttggacaaagatttgatgttactgcatattctaaagaaattaaagagaaatatggtgataaaactcatgaagagttagaagaaatggcagttgaagtaaaaattgctggaagaattatgacaaaacgtcgtaaagggaaagtgtgttttatgcatattcaagaccgtgatggtcagattcaattatatgttcgtaaagatgtagttggtgaagatatctatgaaattattaaaaaaggtgatattggagatattataggtgttagaggaacagtctttatgacaaataccggagaatgttcagttaaggtagaagaatatacacatttaactaaagcattacgtccattaccagaaaaatatcatgggttaagtgatgttgaagaacgttatagaagaagatatgttgatttaattatgaatgaagaagcacgtaaaattgcttttgcaagacctaaaataattcgctctattcaacattatttagataacaaaggatatgttgaagtagaaacacctgtattaaatccaattttaggaggagcaagcgcaagaccatttattactcatcataatacattagatatgaatttttatttacgcattgcaacagagttgtctttaaaaagattgattgttggtggaatggatgcagtttatgaaattgggcgtttatttagaaatgaaggaatggacagaacacataatcctgaatttacaacaattgaggtttataaagcatttagtgatttagaaggaatgatggatttaacagaagggataatttctaatgctgctatggaagtatgtggaacttatgatcttgaatatagaggtaataaaatttctttagcgccaggatttaagcgtatttcaatgactgatgcaattaaagaaaaaacaggaattgattttgctaaagatatgagttttgatgatgctaagaaattagctgaagagcatcatatcgaaattgaaccacattttggatatggacatattattaatgaattttttgaaaaatatgttgaagaaacaattattgaacctacttttgtgtatggacatccaatcgaaatttcaccactagcaaagaaaaatctagaagaccctagatttacacaacgttttgaattatttatctgtggtaatgaatatgctaatgcatttactgaattaaatgatccaattgatcaatatgaaagatttgcaaatcaattaaaagaaaaagaattaggaaatgatgaagcaaatgaaatggatttagattatgtagaagcattggaatacggattacctccaacaggtggtatgggaatgggtattgatagacttgttatgttacttacaggacaagaaagtatccaagaagtcattcttttcccacaaatgaaacaacgtaataaataacaataaattcaatataattttgattttgaatttaaatgaacggttaaaataaaagcataatatttctaaattacgaagtgatatttgatgactttgtgattattagaagattatgctttttatgtttgatctaaaacatgtgctttgaaagtggcatacaatgatttaaataaaggtatgttaataaaataacaatcacaaagaaagtacattctaaatatacttttagttgacaaagtatatttagaatgtataatataagaaggaggtagttttatggcaaatcaaaatttttcaaatcgtttaaggcaactgagaagaaataatgattatacattggaagagttaggaagaaaacttaatgtaaaaaaggctacagtagcaaattgggagaatttgggagttgttcctaattcatatattttaaaaaagttatcttcaatattttcggtttcgattgattatctattgggcaacgaggtttcttctgtatctgaaatagaaatattacataggggattaaataaattaaatcaagaagaagttaagaaagctactgtaatattaggagctatgtttgataatatttttgaagatgaggacgatgaagatgatatataaaccggattttaaattagcaactaatacagccgatatttttctattaagtgcaggtataacacagttcccttttagtttaaagaagcttttaaaaagaataacattatatagtatttcactttgttcgtattcaaaagcaaaacaaaagtatggcatagatccttctaaactaggaagtaatgatggtgaaactataaaaagaggcgataaatatataatattttataatgataatcaattgaaaacaaggcagagatggacaatagctcatgaaataggacatattgttatgaaacatagttttgaaaatatagatgaacaattatattcaaaaatggaagtagaagcaaacttttttgcagcacaacttttgatacctaaccaaataataaatatcgctatagaaagaggatacaatattacaatcgattttataatacagaattttaatgtatctgaagaagcagcaataaaaaaattggagacattaaacaaaaattatgaatataactataaaaaagatgatgatagtcttaatattttatttagtggatttgtagatatgattgcaccaaataaatttgcagaaattgattattttgatgaggaatatgatatgcaaagtagaagagatgaatggtggtagtaaaaggaggaataatatgaatgaattttacttatttttagatgaatcaaaaccaaatacaaatttcaagaattttacatttataatcaaaaaacaaatattgtaaaagaaaagttatttaaatagttatttcaatgtttacattagttagactttgattcatgatatgtgtttgtgtatggtctaaaataaaatatttaatctaaaacgagataggagtgaatatacatatgaaaattactttttttattggtaatggttttgatttaaaaatgggtttaaaatctaagtataaagatttttatgattatttattgtttcaaaaatatgaaaatattatagtagataagataaaagataatccagatgaatgggctgattttgaactatcttgtggaaaagaattaagaaacataactattgataaaatggaagaattcattgaggcgtttggaaattttaaaatagagttttctaagtatctgtcagaacaagagaaaaatattaactatgatcaattatccaatgaaatagctgataaaacatgtgattcaataaataatttttataaaagaaataattcaactagatcgcaaaaattaaattctaaaatcaattcatatggacagcaagtaatttttaattttataatttttaattatacagatctttttcaaaatgttattgatattacaaaatcaaaatataacagtataggttctcatgtatggagaggaataaaatattcacattcaataggtgaatgtataaaaatacatggctctttaagtgaggatatgattatgggagttaacgataatacacaaatatataatgaagatttaaaaaataatagaaaaatacaaacagtatttattaaaccaattttaaataatcgattaggaaatttaaaaaatgaaaaagtatctcaattcattaatgatagtgagataatctgtatttatggaatgtctttaggaagctcagatgatttttggtggaaaaaaatagtacagtggctaaaagattcttcagagcgttatctagtgatttttaaatatttaggggatgaatattttaatactattttatcgtatcaatcaattataaaagaagatgaagatatagataattttttaacaagatataaaatggatgatcaaacaaaagataggttatctagacaaattatgtttagttataattcagatttatttgattttcaattaataaatcaagaagtagataaaatactagtctaaaaaagtaagatatttatgtataaaacaaataaaaataatcatacttgaaattgaataggttcaatgttataatctattcgtgaatcgggcattgttgtatcacaatgcaaaaaggtaaggagtcgcattccttaccttttttggtttttatagtgaacttaacactaggctagttaccgttataaatatttgtctaaccatttgcatatgtaataaacaattacacctgccatgacagaaataatcaaatcggacattattatatcacctcctctccaaacaggagggacgataacaaatgtattatatcaaataataatttgtctaacaatttaatattaagatatattatggtgaaaaaagatatcaattgttatatggatattttcaaaaagtggcatacattttagcatacaaaatgaaataaatatgtataaaatcataaccttttatcttataataatatgaaaaaacatgtaaaaacgcatataaaaattgtatatgaattgaaatggatttagattatgtagaagcattggaatatggtctacctccaacaggtggtatgggaatgggtattgatagacttgttatgttattaactggacaagaatctattcaagaagttatcttgttccctcaaatgaaaattaaaaaatatttgataaaataaaactagttttgatttttaactttaattaatggttaaaataaaagcacagttttcttattcataaagtaaatctgatggctttataaataagaaaactacatttttttgtttaatttaaagttttaatgtttaaacgatttaaaattatcatatttatattttataaattattcatttagtgtaaactaagattagcataagaaggaggggcttatatgataataaaaagtattacaaatcagtatcttttggaaaatgaggagaaccaatattttgatagaaaaagtgctagaataaaaccttctgatatagtaaggcatattgttgcttttgcaaatgctaacggtggaatcttagctataggtatagaggataatggtatagttacaggttttgattatgaaggggcacattcgattaatgaatttttagaagtaccttatttaattgatggtaacataaaagttatccatgatgaaagaacaattgataataagacaattttgttgtttgaaatagaatctagtgacaattatgttataaaaacaagagatcaaaaggtttttttaagagtaggagataaatcaaaattattaaatcatgaacaggttactcaattagaatatgataaaggtgaacgtagatttgaagatttagttatagaagactcttcgtttaatgatgtagatattgaattattaactaaatataagcaaatattaggtacaaatctttctttagaagaaattctatatgcaagatctttgatgaaggatggtcatctcacttatgcaggaatattattgtttggaaaatatccaacaaaatatttgccaaatgcaagagtaagattattaaaatttgatggaaataaaatggaaactggaaaacgcataaatattattaaagatataaattttgaagatgcaattccaaaaattattgaagatataaaaagctaactatataaaaatcaagagtttttgatgaaaaagtttgaaaatatgaaatttttgattttgtatgttaactggtaaagatctttgataagtgaatagtgatttgtcatttttgagcatgacaaaaacaacctttaaaaaggcatttttaaaatttgtatagttatcttaaaagtgctggatcaaatttttgattagtacttaataagtgatatatgattctaagtaattttcttacacaatgaccttgagcacaacgatgacccttaccttgggaaatctttaattcataatattgtttaaatacaggattatgattaatcacaggcaatataatctgatataaggtcttccttagatatttagaccctttcttagtgatagcagtgtgctgtgcagtaaattggctggattcataatgcattggagcgactcctgcaaattttataatttgagaaggctttttatagttgcttatatctcctaattcggctaaaatagaagtaccagagaaatgagaaattcctggtatggataggataggagagttgtttttcacggagaactcttctatttttttatctatttcagcgatttgtttattgatgagttctatttgattgactaaatgcttgatttggataacttcagcagcagaagaaataccaatggattgtttagcacatccttttagtttttcaggtgttaaagaaatacgttttcctctgcctttgatttcaaagcatttacgaatcgttcttatgtcagtattagcgattgtttcagcacaaccaccaaatgttctaagaagatttatgtaaacagtaccatatttagatttaaataagctattgaattcaggaaatacaatatcgatgcatttttgaagacgatttgaataaacgttgagttcttcctttaggttgtgatgatgtcttgtcaattgcttttgttcataaaggtcaaagctgttgactttcgtgatacgatattgttttttacgcttaggagtatcaagaacatcacaaatcattaaggtatcaagtttatcatttttggtaataccaccctgcattttacgtgtaaaatcagtgattttaggattgattaaggcgacagtaaaatgtttgttcaatagatactttaataaagcaaaatgataatgcccagtatcttccataccgattaaaatagagtctttagaaaaaggtttaagtttattgacaagaaaatcaaagccttctttattattagaaaaagaaacaggatcaactaaaagttcaccagtatctttattcataacacaaaagaagtgtttattcttaccaatatcaataccaactaaattcataataaaacatcctttcttgataaaattgtgaaaatggtatccacaacacttagaccacaaaacctggtacaaaatacgaattcaagactcatctaactcatcattgtttaggaataaggtgtggtaagatcctttttaaagtagtcaagccacgaggagaaatacaaatccacattcacatatttcaattttacagaaaaacttaaccgtcatcaatcacggataaataagattgatagataatatgaagtgacctcctaagttgtcaaaaagtggattacgattcataataagattagtaaaaaaacaaaattatgaaagtcgataccataacgacaataggaggtcactatgaaaagtataatttatattgggatggatgtccataaaaatacgtacagtttatgtggaatcaattcatcaacaggagaagttattgcacagacaaaatgtgctgctgaagtaaagaatattcttaaatttattaagtcagctaaagaaagaatgagtgaagaaaatgaggtggatattttaacaggatatgaagctggatgtttaggattttccttatatcatgaacttgcataccatgatattccatgtgttatattagcaccatcaacaatgcatggatcagtcaaaaataaaaaagtaaaaaatgataagatggatgcctttaatattgccactaatcttatgcacgattcatacaaagctgttcatgtaccaacagaacatgacaatgaaatcaaggaatatataggtctaagagaagatgtcatccagtcaagaaagagaatcaaacagcagatcagtgcattggtattgagacgaggattaagatatgaggggaaaagcaactggacagtggcccatatcaaatggcttgaaacgatagaattgccagtaatcgtaagagaaacattaaatgaatatttaaaagtctatgattatttaaatgaacgtattgaaaaatatgatgaaaggatagaagagttttcaaaagaagaggaatataaggaaccggtttctaaaatttcctgtttcaaaggaatagatacattatcagcaatgaagatacatgtcacagtgagtgattttcagcgatttccaacagcaaaggcatttatggcgaatctgggaatgcttccaggagagaattcgagcgcggagaaatacagcaatacaccaatcaccaagatggggaatgcgatggttagaaagacactggtagaatgtacacaggcattagtaagaggaacagttggaaagaaatcaaaagcgttgaaaaaaagacaaaaaggacaggaggatgaaatcgtagcatatgcagataaggcagtagaaagattacaaaaaagatttagaaggatggtattaagagggaaaccatataatgtagctatcatggcagtggcaagggaactagcaggatttatatggggaatggaaacaggaagaatatagaagatgtaaaaagatgttttctatacaattatgaaaatttaaagaaaaaataagaaatggaggacaaaaatcgagaaaaaaagaacacaaaatcaatggcatagaaaagcctcaaaaaaggagaagcaggtttagttatctacggtcctttctttgtggcataaataagatataaaagaagtcgcgatctggaatatcataaattatagatgattcacgtatatagatagttagaacttatttgacgaaccattaaccttggagtagccaatctccgtataacagagtggttaactgtcgataaatctagtattttggggcttttgtatgccattgatgataaaattaaataattttattatgaatgtgtaattttcacttgacaaaggtcacttcataacagaaaggaaaaggtatactgcagatgactaattaaatgagtcatttataatataccagggagatgcattctcaattaagagattttcaatatttaggtgaggatggagtattcaaaataattcccgaatacccagagtttccatggcttgaaggaattgttaatgctgttacacatcgcaattattctttacaaggggaccatattagggtttctttatataatgatcatttagaaatatttagtccaggaaagttacctaatatagtgacactagaaaatatgaagtatactcgttactcaagaaatccaagaattgcaagagttttgactgaatttggttatgtaaaagaacttaatgaaggagtaaagcgtatatacgatgaaatgcaagcttcatttttaaatgatcctatatatactgaaccaaactcatcagctgtcttattaacgcttgaaaatagtattgtttcaagaaagacgagaaaagatgaatatcaaaagaataattttgatccaacaattttgccagaaaaacaattattagtttatggtattatttctagtcatcctggtttgaatacgagagaaattgcagatttactatcgattaaaaagacaagtgtagaaaatgctgtaaaaatattaagaaaaaaagaagttattgaacatattggtactagatcaaaaggtggatatgttattaagaaatcagataattgaaagatatagaccaccgaaagaccaccgaaagaccaccgaaagaccaccgaattatattaaatatcaataattttgttcaaaaaagtatatatatcattatgatgaaatagaagtaagcagagtgttatttagaaaagatgaagttgatagttactatagtttaaattaaaaatgatagaagttgaaattttagatatgaaaaattaaataaagagaatgcttcgaaaatttacatggagtgattgaatattttagattattctattcccatttaatactttttttggatttgaatctcacatagccctcttatactcactatataggaataaataaatatcgttgattttccatgaaaatgataaataaaaatagtgctattaaaaaatgccgataaaaagggaatgtttgaatattgtcaagaaaaataggttcaagaaatagatgaaacaacgtaataaatagaggtaaaatcaagataatttgaattttgtaatcaaaaacatattaataaaatagcatgtgcaatattttaataaatatcgtaattatgagtctatttatcaaaaagcacatgccttttattttgagccattataagtgattgttatacaagtggatgcataaaaatattctttgtataaaactgtccaaaatagtcatacttaaaattaagcaggttacatgttatgatctgcttgtaaatcgagaagcattgtatcaaatgcaaaaaggtaaagaatgttttctcgtttttagagtggacgtaacactagactagttacctttataaatattgtctaacaatttaataatgaaataaatatgtaaaaatttataagaaataggtttatgtattagtttttttgatgtatttgaaaaagatttttatgatattttagtatagcataaagatcttttttaatatcatatattaattgatcatttggataatgataataagtatataaaagaagacaaattataatttataatttaaatttttttgcaagagcttcaatttgacttttagaaataccaaaacgcgtacataaatcttcaatatattgattcaattcttcaggagatttattttccatatctttttcattgattcccaaaccatgcatcatatttttcacttgatcaaacattgaagaatcgccattattatatttattcatcatatcatcatagtattttttagcgccttcaagcatttcatcttcttgctgttttttttcttcaaactgtttttgaagttctaataaaacatcgatttcttcgctatctaattctaattcatcaaaaaaatctaatgcttgattacataaaagctcaacttctaaatcataattttcctggtccaatttattaattaattcaaaattataaaaaaattcttgaattctttgttgttgctgatttgataaaacaatatcctcatattcatcatttaaaagatcatttaaaacaatggtagtataatagataactttttcatgagatgtcaaaatcatttttgtttctatagaagttatttttgaaagtaaatcaataaattttttagaattaataaaagaattatcaaaattatattgacgatctttagtagcgatataactaatactagtattttttttatattctaacttaatgatttcatcataattaataatacctgattcattaagtaaaaaataaatttttttgttagtaaaaatcattcctaaactaccatctttattttcactacagtcaataaaagcaattatatctgtaatatcgttactgccaaaagtatatattgcattacctatttgactagggatgttttcataagaataaaacaccccatttattacaaaatcgttgtctaaaaacgataatatttcttttttatccatatacttctccttttttatttacttaattttgtttcatattgcaattgttgaatcatttctttgcataaactaagaaaatcatctttttccattcctttaacgattgcctcactgccaagtagttgtaagtcactaaaaatacgatctttaaaatcagttgatatatttgaactaggaaaaactttggctccatggcgacgatcaatacaaatatatccctcttgttttaataaagcatatgctttattaacggtcatattattaacatgaagatcgttagctaaacttctaactgttggtaacgactcaccatatttaaattgcccgtttccaatccctcttacaatttcatttcgcagctggatatatataggaatatcactattataatttaaattaattatcatgttcaatcacctctaataatttattgtaaaattttttagtatcatcaattctatcatcattaattatatacgttttatcactagtgtaaataacgatatagcaatcatgcaaactagctaaataaacataacatttcccatatttatcaaattcataattccctttagcataaataccggtatcactaccatttgttcttatacctttacctaaatcatttgagatttcaatcttttcaatattactagtatctataacatgatgataaaactgacttgaaataataatttcattattttgtaatgataaatcaactaaattattagttagatctaaataataaggatagccaaacaaccaagttaaaaaaagaataatagttaaaataattcccccaacaaaatagcgatagctttttttagctgtattaaaagttagttgactgccaccaggcatagaaataagtgttcttggatcataaggattataatagacaggaccaaatatacctattttccaacaatcatcatcactgatagtataattagtttctttgaagtgtaaaagaatatttgcttttttattgcgatagtcatgaactttatataatgtaataattattgaaattaatgaaagtagaatagagataaaaagatatatgaaagttaatttttctaaaagataaagctgtattactaaattaaatagtgaatcacataaaatcaaaaagaaaaagcagtcataaaaagtattttttcgtaatagattaattgttatgttagcttcagaattatcacaaaaggtttgattggcttgtttttttataaataataaaccaatcaataatactagtatttgtaaaaacatatatggatacatcgttatatcagcatcatatttaaccattaagatagttgtaaaaagatcaattaaaagagcgattatataacgttgtaaaccaaacgaatgtttttccattgatgaagaaagctgtaaatcgactttatatgatttatcacttaaaacaagccaattattttctttttttatttctaataatttattacgagcttctttaaaaggaatttgaagaatgaaaatatttataaaaatgacaattataagaaacaacaaaaataaaaatggtgaaagtaattttgctaataaaataaatataactggtaatataaaactgcaaataaacattaaattaagacgtttgttataacgtgatattacttgttgtacgggtacagattcaagagcataatcaggtaaagtaactaaaaataatagtccttctttatactttgcatctcttttcgaagaataataaaaaacaatattaataaacacaatacttataattataagtaacatataaaccacctctttgtattatttattgtaatacaaataatacaaagggtcaataaaattaactacgatcatcttcgtagttaattaatatatttagtctccaaacgaaatacctaataatctagcttgattaacttcttcactattaacatcaacatattttaatttacctgcagattcaattaaaggaatagcagtaacagaattatccttatatactactaatttaccaaagtcgttattcataatcaaactagcaccttcaataccaaaacgtgttgccattaagcgatcatatggacaagggttaccaccgcgttgtacatgacccacacaagacacccttatctcgctatcagtataatgacttagctgtttggcaatatcatagacaaccgaatgtccttcacgtgcagcaacttttaatttatattgtttcttagtaagggcagcttctgctttagaaatagcaccttcagcacaagcgataatagtgaaattttttcctgtcatttcacgttgttttattgctgcagctattttttcaatttcataaggaatttcaggtaataagattacatctgctccagaagcaattcctgctgcaagacagatatgccccactttatggcccataatttcaacgataaaaattcgattatgactagctgcggtagtatggatttgatcaaggtaattagttgcaatatcaatggctgattgatagccaaaagtataatcagttccccaagtatcattatcgatagttttaggaagagcaataatattcaaaccattttgagccaataaattagccgactttaaagatccattcccacctaaaacaactaaacaatctaatttaagtttcttgtatgtttgaatcattgcctctactttattaaatccattttcaattacttgcattttcttaaatggacatcttgatgttcctaaaatagttccaccgatattaatgatgccggaaaagtcacttggtttcataattttatagtcaccaaacatcaatcctttatatccagataaaaaaccaatgatttcaagatctttaacattttgatataaggttttaactaaacctctcattgtagcatttaaagattgacaatcaccaccacttgttagtatacctatgcgcatataatcactccttttaaaaaatgtataaactaatattaacgtctatttaaagaaatattcctgactattaagttctggcaatttatttttaatacgtttatacgtactgtctgctaataactcatatgccttaacattatcttgtaacatcgtattaaacatgaaaataattctcttttttattttttcatctaaaataggagctgctacttcaactctacgagaaagatttcttgtcattaaatcagcagaagaaatatatattttttggtcttctccagtaccaaaaatataaattcgcgaatgttctaagtatcgtcctacaattgaaataatacgaatgttttcagtgtaatcttttattccaggaataatacaacaaattcctctaacgatcatatcaattttaactccagcctggctagcctcaattaatttgtcgatcatttgtttactagtaattgaattacatttaaaaccgatataactatctttaccagctttagctaaagcaatttgttcatcaatatattcaaatatttttgtaatcatacagttaggagcaaccatcaagtagttaacttgattttcagtttctccaagacttaaatgattaaaaatagcattaatttcttcgccgatttcgcgattagatgtcattaaagacagatcagtatataatttagcagtattttcattataattaccggttcctatttggcatacatattgaataccatgactgtttttgcaagttatcaaacataattttgaatgaacttttaaaccatctagaccatatataacacgacatccagattcttctagacgcttagaccagtcaatattattttcttcatcaaatcgtgctcttaattctactagaacaactacctctttaccgttttcagcagctttaattaaagatttaacgattttagaattcttggctactcgatataatgtcatcttaatactagcaacactaggatctagactagcttcatctaataatcttaaaaatggtgacatggattcaaatggatatgcaagtaaaatatctttctttaatatttgttttatcattggaatccggttttctaccgatggactatttttagcttctagttttttataaaacatttggggatgcataaatttcaaatgatctcttaattcactgatgaattttaaatcaagtggtgcactagaaatatatatttgattctttttcaaatttaagaaattcatcaacattaaaatttctaattcttctaatccttctgacatttctaatcgtataggacataattttcttctttgtttaattaaagtttccatcatttcacgataatcttcatgtccttctaatgaatgatcatcttcatctatatcagcacttcttgtaactcttataaatgctttatttttaatagtatatttagcaaatattttagagacaaaatgcaaaattatatcttctaccaaaataaacttaccttgcatatttggaacagccagtattcgattgtccatagcattaccacaggaaattattcccattttacgtttacctttttttgattctaattgaacgataatatataattcacgattatttaaaaaaggaaagggttgtctttttgatactacttgcggtgaaattaaaggtaagatttcttgattaaaataattttcaaaatatttacgatcctctttgtttttcaattggcgaaatttaacaattccccagccataattctctaattcactcatgatattatggtaaatacgatcttttttcttatttaaataagttattctttttaaacacgcttttaactgttcttctcctgtcattcctgttttattatcttttgatgctggataaaaaagcatttgatcatataaagaaccaattctaaccataaaaaattcatcaagatttgattggaatattgaaataaagctaagtttttctcccaatggtactttagaatcttttgcctgcattaaaacgcgatcattgaattttaaccaagacagctctctattttctctacatttatacattttattatatcctcctctatataacatcaaaataatatttatccaaaaatttatcaagaaaaattaagcagttaactaaatatttacatgtggttaatatatagctaataaaaatattttaagatattaaaattttacaactaactatcctcaatatcaacgagataatctaaaaatataaaatttattgtaacatagtatttaattactaaattttagtgatgttttaagtaaaaaattactaaaactgttgttaaaaaagcttttacgtggtaggatttaagtgtgcaataataaaagatatttatgggatattggaaaaggaggaaaaaaatgaaaaaaagttgggacaagaagatttcagctgcactaacagctacattattattatctgtagctccagtcaacattctagctaaacccgatgcaagcattacacagtctactcctgaagatgtatttgttgacatcattggagaaggtgaacgttctactttattcaatgaaaattggaaatttcatcgcggtgatgtcactaatgcacaaaatgtagatttcaatgatacatcatgggaaaatgttaatttgcctcatgattatagtattgatcaggaatttactacaagtggagaagcagaaagtggatttttaccaggaggtataggatggtatcgtaagacttttgttgtaccagaaaaatatcaaggcaaacagcttatggttgaatttgatggtgcttatatgaatgcggaggtttatttaaatggaaagaaattaggtgaacatccatatggatatacagcatttgctttcgatcttacggatgaattggtttttgatggtaagacagaaaatgttttagttgtaaaaacaaacaataaaattccaagcagtagatggtattctggaagtggaatttatcgagatgtaactttaacagttactgatgaagtacatgttggatataacggcacacaaatcgttgctaaagatttagagacaaataaggataaaactgtagaagttgatgtaacaacaacagtagaaaatgatagcagcgttaataaaacagtgactgtaaaaaatacgttgttcgatgaatttggtcaagcagctagtaatacaacttctagccaagttgaaatagctgcagatgatagtcaagatgtaaaacagatcgtcgaaatagaatcaccagaattgtggtcagttgatgatgcaaatatgtatacattgaagacagaaatagtagatggaaatgaagttttagatacatatgaaactgattatggcttccgttattataattttgataataacactggtttttcattgaatggtgaaaacatgaaattaaaaggtgtatgtatgcaccatgatcaaggagccttaggagcagttgctaatcgtgacgctattgaacgacaagtaaaaattttaaaagaaatgggatgtaatgcaattcgtgtaacgcataatcctgccgcttcagttttattagatatttgtaatgaatatggaattcttgttattaatgaagcttttgatggctggacagaatataaaaatggaaatgttaatgactatactgcccattttgaagaaacaattactgcagataatcaaattattaacggtgaagcgggaatgcagtggggcgaatttgatgttaaagctatggtagatggagcaaaaaatgatcctagtgtaattatgtggtcaattggaaatgaaattgatgaaggtgtttctggcagcacaactcattatgtagatgtagctagaaatattattaactggattcaagaagtagatacatcacgcccaattactaatggagataatcgtaaaaatactaatcctagtgcaataatcagtcaaatcaatcaattgatttatgaatcaggtggtgttgtgggaatgaattatgctagtaatagtcaaactgtttctatgcataacgcttatcctaactggccgttatatggttcagaaacagcaagttcaattcatagtcgtggtgtttataatgttactggtagagataacactaatcttcaaatgtcagaatatgataatgatgaagccaaggtaggttggggtcattcagcaagtgatgcgtggagttttgtaatccaaaatgattttaatgccggtgaattcgtttggacaggattcgattatattggcgaaccaacaccatggaatggagtaggaactggtagtgtaagtggtcaaggagcaaaaccgaattcatcttattttggtatcgtagatactgcgggatttgcaaaagacacatattatttatataagagtttatgggatgaaaatagtactactttacatttaatgtcaacttggaacaataatgaaatagttaaagattcaagtggtaagatcaaagtagatgtatttacaaatgctgctaaagtagaattatatttaaatgatgaaaaaattgctgaggatacagcgactaagcatacaactgctttaggatacacatatcaaacattttctagtggtgaattttatccaagttttaaagttgcctgggcagctggaaagttgagtgctaaagcttatgatgaagatggtaatttaattagtgatactgaaggtagagatagtgtatcaaccaatggtgatgcaactaaattagatgcttatgcagataaaactgaaataactgctgatggaagcagcttatcttatataactgtagatgtaaaagatgcaaataataatatagtagctggtgctaacgatagaattacttttgacatagaaggtgaaggaaaaatagttggtgttgataacggagatccttcagatactgatagttataaaggtaatacaagaaaagctttccacggtaaagctttggtaattgttcagtctacaaaaaatgaaggatcatttacattaacagcaagttctaatggtttagcttcatcaagtgtgacagtaaatacaaagcaaacagctattgaaggagatatatatttacaaagttataaaatttctaagaatatgtatgtttcagttggtcaagaaccaattttaccagaaacagtagtaggtacttataataatggtgaaactagagatttaacaattgattgggatagctatgataaagcgctaataaatagcgttggtgagtttataattacaggaaaattacaagatagtgatgcaattgtatctgtaaatattcatgtgattggcgaagttgtagcaatggaaggttattcaacagtaactaatgttggagttactccagctatgccacaaacattacgtggtatttatgaaaacggtgaatatagtgaagcatttccagtaaactgggatattcctgaaaatgcttttgcagcggaaggaatcgtaacgatcaatggtacagcaaatattttggatagtgtccaaaatgttaaggcaacgatcagagttgaaccaggagttgcggaatctactaacattgcttccaaaaataatgtggatgctccagtatttaccaatggtagaatgcaaaatggtgtagctagtgaaccttcaacgacagcaattagtgattcattgcttaaattaaatgatggtattactaataatagtagcgatactaatgctagatggactaactgggcaattagagatgaaagtccagctgttgatacatatgttcaattagaatggcaaaatgaatataaaatgcaaaatgtaaaactatggcattttacagacagtgcatatagtgttttaccaggtgatgataatgttcgttttgaatattttgatagtagtgcaaatgaatggaaggaaatagaatcttctcatattactcaagtatcatatctttctggggatacaccatatggatttataaaccctattacaacaagtaagttgagaatttggttaaaagcacctcaagtaggtaaatgtatcggtttaacagaagttgaagtttataattatattgaaaaaacactagctaattcaacagctaaccttgatgaattaaaattaaatggtacagtaatagaaaactttgatggttttgaaggatataatgccgaaactaaaacttatacagttaacctaggaaataatgattatccaagtgttgaagctcttgccaataataatgaagcaattacggttttaccagtatatgataatgaagttaaaattattgttagatctgaagatggaaatactacagaaacatataaaattaaatatgttaagactgtagtaaataaagaagagttaataaattatgtaaccagtccagatattaccatggctgtcggggcagctgataaatataccgtagctacatatcaagtgtttaaagcggcgtatgatagtgcaaatgaaataatagctaatgaatcagcaacacaacaacaagtagatgctgcttatcaagctttacaaacagcttttgcaaatttaaagaaagtatcaacaggcgagacagttgataaaagtgcattatctatcgctgtacaaatagctgaagcagtatctgatgctgatttagaaaatgtagtgcctgcagtagtaaacgaatttaaagaagctttagaagaggctaaatttgttttaaatgatgataacgctagtcaggaaacagtagcagcttcatttgaacgtttagctaatgcaatgtggaaattagaattctttaagggagataaggaattattacaatcatttatagatcaattctgtaacttaaatgaaacggattatagcaaagtaacatggacggtttttgaaacagcattaaataatgctaatgaggtattagcagatgaaaatgcaatgcaggaagaggtagatgaaacttatactaaattagtaaaagcattcttgcagttaaaattaattccaaataaagatttattaaatgaattaataaataaagctgaaagcttaaattcagctaattatacgatagcatcatggaatgctttacaaaatactctaagtgatgttaaagctgtttttgaaaatccggaggcaactgttgaagaagttactaatgctcaatcagcaattgaggcagcaatagctaatttagttacaaattcaaataattcagttgatttaaatacagattcagtaaaatcaagtgtaaaagatagtgcaatcaaaacgggtgatgcaacaagctttgctggtgtaaccagtttagctgcttcattaacagctttaggatacttatttgtatctaaaaagaaaaaagattaattaaattaaaagacagaattttctgtcttttaatattatcttaaaaattttcactaacaaaaaaggcaacaaaacgttgcctttaatcattggttaaattaaatttctctaaaatatagaaaataagtgataataacatagcgacaatacaagctaataccataccagttaactgaattccaccaaaatttaaagtaatactacttaatccagttacgaaaactacagatgttaaaataagatttttgtttattgaataatcgacatgttgatcaactaaaattctaagtccacttgtaccaatcattccataaagcaggaaactaattccaccaattacgggaccaggaatagtttgaatcaaagccgatagaggacctacaaaagaacagataattgagatgattgcagcaccagcaataacttgaacactgtatacacctgtaatcgccattactccaatattttcaccatatgtagttgttggaactgatccaattaatcccgaaatcattgttgaaaagttatcacctagtaaagagcgatgtaatccaggctctttaattaaatcacgacctacaattttacccgttacgacttgatgaccgatatgttcagatgtaataacaagaataacaggtaaaatcattaaaattgcattaatatcaaattttggggtagtaaaattaggaagagcaaataattttgcactagtgacagctgaaaaatctaccaaaccaaaacagatagcagagatataaccacaaataatagcaattaaaatgggtattacacttaaaaactttctaaaacaaatatttcccaaaacagctacacctaaagtaattaaaaatacccaaacgttagctgcttgaatactatcacctaataaaccagcattgctagctgccgtagcactaagctctaaaccaatcaaagctacaactggtcccatagctgctggtggtaaaacaatgtcgatccatttggtaccacattttttaattataaaggctaatacacacccacaaaaaccgacaactacaaatcctcctaaagcataaggatatccaaatttagctattacaatgtttgctggggcaataaaagcaaagctagagcctaaataagctggggcctttcctttagtaatcaagataaataataatgttccaattccgttcataaaaagaacgatagctggatttatcccaaataaaaatggcactaaaacactagctccaaacattgcaaacatgtgttgtaatgataaaggtagtagcagttttccaggaactttttcttctacttgaataatacgttttttagacattttttcctccttttaatcgactgtattatgtcattttttttctataatgtctagttaaactttgatttttataaaagttacaaaaataacgattttagtatgaatatgaaaatttatttttttatgttatactttttaaaaggaaggtaagtgtgaaaaataattgaacccaatcgtgagtaaaaacacaaaaaaagacgaacttaaaaacaagttcagttttatttagaaaaaacagaatattatttaggaatatcttgaattgttgatacatcaaatccctgtgattttagaaaatcaagtgctgtctcaactgtataattgttcttttctttttgtggctttggattcttaaatgattcatagtctgaaggattgaacttttctccagtaagaatcatatgataaatactgacaagcatcatccttgcaatagctatgattgctttcttgtgtcctcttcttttcttgatttttgtatatttttgaccaaaataactgtttttgtttttgatagctgccaatgcacattgtactaatactggtttaagatattgtccagctttgttgatacgaactgatttcttctttcctgcactttcattattggcaggagaaagtccagcccagcagcatagttgcttatctgtttcaaattgagtcatatcaacgccaatttcagaaatgataagaatggcagacataagctgtattccatctatttctgtaatatgtaaaaaatcatcaaagtatctggaagcacgtttgatgatttctacttcaacagcttcaatatgttgattaagttcattcatatgtgattgaatttctgccattttaaatctttgatctggctcaatttttgaacttttaagagattcaactattttatctttgtttttgcacttaccatgaataagttttgtgattttatcttcatcaataacttcagtagatagaacttcattcatgacggcctgggctgtttttccaaaagtatcagaaacaacagaagccaaaccaatattggaaacagtcatggagttctgataacggttacgttcactagttctcatacagatgagcttaaaacgataacgagagagatcccttaattcacgaatatccttaggcgggataaaagaagatttgagaagatcatgcttgaaaagatcacaaatccatttggaatctttcttgtctgttttcttgcccttgatagctttgacatatttaggatggacaagaacaatattcattttagcttcagtctcaaggacattaaagacagggaaccaatacttaccagtggattccatgcagacatcaaaacattcgtgttcaataagccagtttttaagattatagaggtcaaagttaagagaagagaaatctttctgaatatattcagtgacatgagttttcttgtcagtgataccaatggtagcgacgataaggttcttgtgaacatcaagaccagcacaattaaaacggtggattttaagcataaaaaaactcctttcaaaaaaggagaagtggcattgactgtcagtctgcaaaatatcactatagttgataaaaacaatcttaagtgtccaggctctaagtcctacttgtttgtgcttgaaagactgacggcgacttataattattcaggatattctatatagagtagaattgcctactctcctccacgtgctctgtagtataccacctctcttataggatactacaaaaacgattggatgagaattatttttaataaaatgtttgtgtctgaccgacgaaggcggacggaaatggagggaattatgaagatacgtaaagcaacaatcaatgatttagaagagataactaaaatagaaacaatttgttttcctgaaagtgaagcagcatcaaaagaatctttaaaaaatagactattaatttatcctgaacatttttggcttttagtaaaagatgataaaataataagttttattaatggtatggttactgatgatgttactattagtgatgaaatgtttgaaaatgctgatttacataatccccaaggaaactatcaggctatatttggggtagatacattaccagagtaccaaaaaagaggctttgctggaaaattaatggaagttttaattaaagaagcacgagatcaaggacgaaaaggatgtatattaacctgtaaaaaagaattactccctttttatgaaaaatttggttatataaataatggagtttcaaaatctgttcatggtggagcagtttggtatgatatgaaattagagtttaaagatgaatgatttaactaaaatgggaaagtatctaagtttgattttaaggcataagcctgaagtaattggtatagagcttgatgatcatggatgggcagaggttagtgcattaattgaaggaatcaataaaacaggtcgttatattgataaagagattcttgataaaattgttgagacaaataataaaaaacgttatcaatataacgtgaatcaaactaagattagagcaaaccagggacattcaattaatgtggatgttgaattacaagaaaaaactccgccaaacttgttgtatcatggaacagctaagaaaagtttagagaaaataaaaaagtccggaatcaagaaaatggaacgtttatatgttcatctatctaaagatgttgaaacagctaagagtgttgggaaaagacatgggctacctgtagtattggtaatcgatactaaagcaatggtaaaagatggatatatattttattattctaataatggtgtttggttatgtgatgatattgattataagtatgtaaaaaaagtgatagattagctattacttttttattatagatttgatgaagataacaaaattgtaagatttgtcaattaactataaacggattttttatagtagtataataaatagaggagttggtagaaatgaaaattatgattgttgaagatgacctggctttagcacatgaattagaattattgtgtcttaaatggaattttgatgctgaatgtattaaagattttaaacatgttgataaagcatgtaatcaatatcagcccgatttaattttattagatattaatttaccattttatgatggcttttactggtgtcaaaagattagaaatagttcagctgttccaattttgtttatctctagtcgtgaacaaaatgctgataaaatcatggctttatcggcaggtggcgatgattatattgaaaagccatttgatttagaattgttattagtaaaaatcaaagcaatgttacgccggacttatgaatatcgttatttggaaagagagtatcttgataaagatacatattatgatgttattagcggacgttttatttatcaaaatcaaggtttagatttaactaaatcagaggctaaaataatgagtacccttatacaacagcgtggaaattgggtgactagagaacagttgatgatggtgttatggaataccgatgaattcatcaccgatgcaacattatcagttcatatttcacgattacgtaataaattaaatgaattagctaagggcaaagatattattaagactaaaaaaggagtgggttattatattgattagatatttaaaggaacaaaagaggtcattgatcatagggattatgttactattgtttattaatatttattttatttatttatgtggaagccgtttatatatcaatgatttgatttatcttgatgtgatcttaatttttataagtggatgctggttgattcggaactatttaaactatcgacaggtttacagaatgatgaaaatgaatgattttattactactgataaattagatagatatttatcaaatcaggtactagaaataatagaacaaaataataattattatcaatgtaatattaataacttgaacattcaaatgcaggaactggtagattatatctcgcgctggtcacatgaagctaaattaccaatcgtaactatgcgacttatgaatgagagaactaatgacttgattttaaaaaaggaaatgcgtttaactatagaacgcctacaattattattaaatacaatgttgatgtcaagtaaactgagaaatccagaaaatgatattaagattgaaaaaattttgttatcgcaagttataaaagaagcgataaagcatcattcatatttcttgatcaatgatcattttacaatcgttataaatgtgaaaaatgaatatgtttatagtgatcgtagatggttaacatatatgttggatcagtttattacaaattcaataaaatatagtcaagataatccaagtttaatttttacagttgtacaaaatgatcgaggtctgtatttaatggtagaagataatggaataggtattactaaggaagatgcgccgtatatttttgatcgaggttttactggtcataatcttcgtgacggtgattatcgttctacaggaatgggactgtattttgttaaagagatagctttaaagctgggaattgaagtaacacttgatgaaacttatacgcaaggatgtcgatttaagttgtgttttgtagataatgcggattattttttggtagattactaaaatgttagattgataagacaattgtaatgaaaacgataggattttaaataataaaattgataaactttagttgtaatctaaggaggaattaaaatggttaaagtagtagaaataaaaaatcttgttaaaagctacggtggtaaagattatcaaactaaagttttaaaaaatattaatttagatatttatgaaaatgattttattgcaattatggggccctcaggagcaggtaaatcaacattattaaatatgttatctactttagataaacctactcaaggacaaatttttattgatggtgaagacattactaaagtaaataataaacgtttgtcaaagatcagacaggaaaaaataggttttatttttcaagattataatctattggataatatgacattgcaggataatattgctttgccattaagtttaaacgggataaaaagtgatgaggtaatcgaaagaacaaagcagatagcagcattatttaaattgagtaatcatctaaaaaagtatccctatcagttatctgggggacaaaagcagcgtggtgcaagtgctcgagcattgattactaaaccacgaattatttttgctgatgaaccaactggagcattagattctaaatcaagtaaagatctattggaatcacttaaatatgctaatgaaaatgaaaacgctaccattttgatggtaacacatgatgcttttagtgcaagttatgcaaaacaagtatatatgttaagtgatgggcaaattaaatgtcgtttaaatcatagtggttcacggcaaaaattctatgatgaaattttaagtttactagtttcgatgggaagtgaacaaatatgagtttgtttaaattagcgtattcaaattttaagcgcagtgttaagaactatattgctttgatcatttcattatcatttgccatttttattttttttaattttcaaaatattgctttttctgatgcaatgaatgttttaaaagaacgaaatagtgagtatatttcaattattattgaagtgatttctattgtacttataatttttgttttcttttttatttggtatgcaacaaatgtttttttatcacaacgaaaaaaagatattggaatctttacatttatgggattagacaacgctaatatagcgaagatgtatgtaattgaagtaagtatgattggggttttatcgctattgattggtcttggtagtgggatattattttcaaaattgtttacgatgattttattaagaatatcagatattagtgttgatgtatcatttacattaagtattacttcgatattgataacagtattgttgtttatggggatttttattatcatgattgttaaaggatatattaatattttaagaagcagtgttttggaaatgttgtcagcagccaagcaaaatgagttaaaggaagaaaaaggtattgtttctctattaaaagtaattatagggttattattgcttgtgggtggctattattgtgctttacaagttggagatatgtcttcatttacttatattctttatgcagttgttctagttattgttggtatttattttctatataatggaataattcctttcataatcagaaatttatcaaaaaacaagaaatatttatatcaaaaagaacgtgtattatggataaacaatctagcgtttcgtttaaaaaagaattaccgtacttatgcaatggttacgattttaatgatttgttcggtaacagttctagcaacgtcatttgctatgaaacagcgctatgataatatcacacattttaggagcacatattcttattcaattatgtcaagtaaaccattaaacgcagatgaaattatgaaaggaattagtaaaactaacgctatcgactatcataataatttcaattatttagcactaaataaagatgctgttaaaactaaatttatttataatcagtatggtcttgtttcatacagtcaattaaaacaagcagcaaaagatgctaaaataaaatttaatttaccggcattaaaggatgatgaagtaattaatttaacaagattatatttattagatatttctgattctgaaaataacccaactgttgaaattaatgaagaaacatatcgaattgtagaagaagtatctgaatcatatctaggtttaattcaagaaaatatcagcacatatgtagtaaatgatgatgtttatgaaagattaaaaagtgctggtcaagaatactacatgtataattataaaattacggatcctaataattatcaagcttctataaattatttagaaagtataactcaagagagttcagattatgttggatatttagccaatgatcctaatgatagtgatattgcttgggtaagagtaatgtattcgatttgtatcttcctatttttagtatttattttagctagtggaagtattatttttatgaagttgagtaatgaagcgtttggggataaagaacgttatgctgttttgaaaaaaatagggataaatgatcgaacattaatcaaatcaataaaaaatgaaattcgttttgcctactattgtccatttgttttaatgactgtgtcatcatacttttcagttcatgcacttgctaatgtgatgaaaacagaattatatataataaatgttattagtgcagttgtaattttggtaatattttatgttatttataaagtatcagttttaacttttaaaaataaagtcattaatgggaactaatttagttcccattttaatattctaaagatttaattatgatgataaataatgtaagtataaaatatatttcgatataaatatttttacgcatataatttgcttaaagttgtcttatattgtagaatatcaacgaaatataacagtgttatattttgggaggtaaagatgacaacacaagaaaggatcgttaatattgcaactcaagagtttttaaataatggatatcaggctgcttcgttaagaaagatagctaaagcagctagagtaacaactggagcaatgtatggttactataaaaataaagaagcactttttaatagtatagttgaggatgttggtaaaaaattcaaagatgactatttagttaaaggaatagataagatagctattgattacatttatcagaattttgaaatttttactcttattatttgttgcagtaagcagacaaaatatgaaaaatacttagatcatttagttgatgataaagtgaagcagctaaaagggcaagggtttgatgataacttaagtcatatcataaatcattcatatttgtttggagtatttgagatcgtacgtcatcaaatgtcaaaaaagcaggctgaaaagtttgtaagtgaattacaggaattttatcaggctgggtggaataaattattagaaagaaaggaacgttaagatggaaatattaattggaattttaattccgtttattgggacgacagcgggagctgcttgtgtctattttatgaaaaataaacttaatcttttggttcaaaaaatattattaggttttgcatctggggtgatggtcgcagcttctgtttggtcattattgattcccgcaatggatatgtcagagaacatgggaaaattggcttttgttcctgcgacagttggttttttactgggaataatatttttgttgttattagatcgaaacattccgcatatgcatttggataatgaaaaggaagggcgagaaagccaattaaaaaaatctacaatgctggtattagcagtaactatgcataatattcctgaaggaatggcggttggtgttatttttgctggagtagtatctaatagttatggagtgactagtgcaggagctttagctttagcgattggaatcgcgatccaaaactttcctgaaggagcaattatatcaatgccgttaaaaagttcgggattatctaaaacaaaatcatttatttatgggatgctttcaggaatagtagaaccaattggtgctggaattaccatattaatggcatcatttgtcatgccggttttaccttatcttttagcttttgcagctggagcaatggtttatgttgtagttgaggaattgattcctgaagcttcacagggacgacatagtaatattgcaactattggttttgcaattggctttgtagtaatgatgatcttagatgtggccttaggataatctttacataaatttaattgccaaagtatagtttgtttttctttatataagtaaaatggaagtacagagataatatgaagtgacctcctagttgccaaaacgtggattacgattcataatatgattaacaaaaacaaaattatgaaagtcgataccataacgacaataggaggtcacaatgaaaagtataatctatattggaatggatgtccataaaaactcatatagtttatgtgcgatttatggaaaaactggagaaattttaggagaaactaaaataagttcagatattaagcttattgaaaaattcatcaataatgcaaaaaagaaaatcaatgaagatgttgatgttttggctggctatgaggctgggtgtttaggatattctctatattggcaattaaaagaaaaaggaattgcatgtgatattctggcaccaacaacaatgcaacgttctgctaagaacaaggtcatcaaaaatgatagaagagatgcacaaatgattgcaacaaatctagctaatggttcatataaagcagtttacgttccacatgatcatgacgttgagataaaggaatatatacgtatgatgaatgactttaaggatgaatcaaaaaaagtcaaacaacatatcaatgcatttgtattgagattaggttatcgttatggaggtaaatccagatggatacctgctcatataaaatggctaagagggctagaactcaattctatgtataaagagatattggatgaatatttatcacagttagaagaattaacagaaaagatagagagattccaacataaattagaagaattatctcaaaaagactcatacagagaaaagataggagaattgcgctgttttaagggtatagatacaacagcagcaatgaccttacatgtagaagtatcagattttaatagatttccaacagcaccagcctttgcatccttttgtggactaacacctggagaggattcaagcggagagaaaaataaacgtttaagtataacaaagcaaggaaattcacttgtaagaacaacattggttgaatgtgcacaggtactggtaagaggaacaataggcaaaaaaggaaagaaagtgaaatcaaaacagttagggcaggatgtaaaggtcattgattatacagataaggcagtattaagattacagaagaaatatcatcaaatgatattgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactattccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataattcaccgaataacatgatattaagaggagtcaataaaaatatagcagtaacagcaatagccagagaattggcatgctttgtatggggagtagaaacaggtcatatcgcataaaagatgattatgaatagaaaaaatataaagaaaggggaagttgtgaaggaataaaacaagataaaaacatcgaaggcatagaaggacttcaaaaaaagataacaggttcaactatctaagaaatcacctttatggcaatgttattttgataaaaagtcgcgagtttattgaaatgatgaaaacattgacccacgttttgagattatagagttgtcgacgaaccattaacctattggtaaccaatccacgaataacagagtggttaactgtcgcaggatctataagtttggagtctttgtatgcctttgatgaaacaatttaataaaaatattatgaattgtatatttttgtcttgacaaaggtcacttcataacaggtgattatagtgaaaaaattattaggggtaacaacaagtttagtaatcagtgtaataaatgttaaaagtttattggcttacaatggtagcgaaagtactaatctatcaggaggaagagttttattattgataccgataatgttaggaattgtttatctcgcaaataaaagcgaggtaaaataatcatagcgattttttaaatatataataatcctgatatttaacatttttttaacaaattagtgatattatttaatttgtaaaatatgtataataaaggtaaggataaacatatatttaataaggaggcggttgtgatgaacaaatttgctttaattgcggtgagcttatttgtgattgtggaaatcctgattggagattgcgttatccaggggatcccgttatggttgatagcactaattttatttagttttatttggatgggaataatttgtgtgaaggaaaaagttcaaatcaaagattcatattaaaagagatcttacgatctcttttaattatggttgaacatgtcaaatgatgaagcaatcattaaaaataacaagccagtatgaacccaaaagattgtataatctaaaagtccatgtaataaaatagcaacaatgcaggcggttaccaaagcaacatagcgaagattaagcctttttttatatacttcaaataatcttttacaattatcaactatataaggaacaagggtagcaataccaatgatcccaaatgataatacaggatcaagataaacgctatgtgcatgttgagtaacatgaccattatatttttcaaaaatcatcatataagtcattggtccttgaccaaataatggatgtgctttaattccttcaatagcagcatgccatattttttttcttacagtaaaattatcaattaatttttcaactcttggaaattgttgcggattaatagcaaaataaatacaacctataatgcaaataatagcaatcagcatacaaattcgataattcttattaattatcaaaaatactaatacagctactgctgtagcaataaaagcggttcgacaaccagtcatatataataagaaaaaattgattcccgcaacaataaaataatatatttgtttttttatgtttttagttccaaaaagtttataaccaatcatcataataataaattcaatcatcatagcataataattagcattgaaaaaaacagaattaagtcgattttcacgccgactaaaaacctttaatgtaaaatgatcataaccaaggcgctgtaagatctgcatttgttcatacaaaccatagatagcccataaaatagataaagctatcagcatatccaaaataaattcaaatacttcaacattaatatattttcgataataaagcatcaatgaaacaaaaataaaaattaatacaacacatcccaccccgatccaattttgataaaacaaagaaacaatcagagttaaagacataaaaataactaaatacttagattttggggtgcttttaaaagcactaatgatttttttagtgtacaataagtacaatgtttcaagtaataaaaatggaacacaaatatagaacggagtagataagctaagagcggtggcaataatcatcaactgctctttagaaaagcgttcttttaatgaatgaataaattgcatagttgacctccaagtactgttactatatcataattaaaggatcgatacaaataagaggagttatatgaaaaagtatttatatgtttttaattatccccctgaggataaagagttatgtgctctagagtttagagctttatttaaagataagttcaaaagtaaatattatttgagtaatttaaactatagtgttgataaaagtgtctttatgaaagctaaaatcgatatttggcagatcaatgatgattttaatcaacttattaaacaaataaaaagtttacataaagaatatcaaaattttaaagtgatttatttgaaaaatcaaatcacacatgttgattatcaagaaagtttacaaaaatgtaaagatatctcatgggcaattgaaggtagtgtcaatatgtccaaacctgatcatacgattgcaattacaaaattaacaaacaactggatatgtggttattatcatcatggtgtgccctcatggaaaaaacatgatgataagccaaatactttttcaaattcactagatattcgtttagcgagaacgttagttaatattgctgctggcaatcaagaccaggtgagaatcgttgatccatgttgtggcatgggaaccgtagttctagagggattagctttaggcttagatattgaaggttttgatatttctcgggaaatatcttggctggcaagaaaaaatttaaaatattttgggtatgatgaatatttgataaataaagtaagcatacatgatttagataaacattatgatgtagctataatggatattccttacaacttatataccccgatcacgtatgaagaacaatgcaaactgattcaatctgcccgaaaaatctgtgataagatggttattgtaacttacgaagatatgagtcaggaaattaatcaagctggttttttaattattgatggctgtattagaaaaaagactgagtatgtaaaatttggacgctatatttatatttgtatttaatattagataaattataattctttttgtatttataaagagatagggtataataaatcaagattagggggttagataatgaaattaatgagatatgtaaaagaatatcgacttccagctattatcgggtttgtttttaaaattgccgaagcagcactagaattaatggtacctttagtaatggcagatatcattgatgtcggaattaaaaataatgataaaaattatattttaataagaggtctaatcttagtaggattggcagtggctggttatttatttgcattagtatgtcaatattatgcatcagtcacatctcaaagtgtgggaactaaattacgtgaagatatgtatcatcagataaattgttatgatcatcataatcttgataaattaaatgcgccaactttagtaactcgtttagtcaatgatgtcgtccagatacagttagcgatagcaatgacaataagattaacgtcacgtgcgccatttattatgtttggttcattagttttagcttttttaattagcggaccattagcctctatttttattgtaggagcagttattttagcgttagtaatgttgatgataactataatttcaatgccttattttaaccgtgtccaacaaaaattagatcaaataagcttaatagttagagaaaatctagatggaattagagttattcgtgcatttacctgtcaaaataaagaaattcataaatttaattatgagactaagaatcaaaaagacattcaagtaaaagtaggaaggattcaggctttattaaatccttttacatatttgattgttaatattgcaattgtattaatagtatactttggtggtgttgaagtaaacattggtgatctatcacaaggtgaaattattgcactggtaaattatatgaattcaatattattagcgttgatcgtttttgcaaacgtattatcaatttataataaagctggagcgagctatactagaatttttgaagttcttgaaactaaaccagaagttagcagtgacggtcaagaaaaaaactggataaagaatgataattgtattgagtttaaagatgtcagttttgcttatgataaaaagaatgttttagataatttgaactttaccattaaagctggagaaacaattgggattattggcggaacaggagctggtaaaagttcattggtgaatttaatggcacgtttttatgatccttctaagggagaaattttacttaatggaagatcgataaaagactatgaccttcaagcgttacgtggttttatcggttttgtgccacaatacgctgccttgatttctggaacgataagagataatcttcgtttaggaaatcatgaagcaacggatgatgaattggttcgtgctttaacgattgctcagggtaaagagatgattgaagataaaattgatggtttagatacaatgattgaacaagggggaaaaaatctctcgggaggacaaaagcagcgattgactatcgctcgagccttagtcaaaaatccgcaaattttaattttagatgatagctcaagtgctcttgattatgctactgattttaaattgcgacaagagttaaaaaaattggatatgacaaaaataattatttcgcaacgaaccgcctcagtagaacaggctgataaaataattgttttatatcacggagaattggttggtttcgacaatcatgaaaaattattgcaaaattgtaaaatatatcaagaaatttatgattcgcagcatagtagggatggtggtaatcgtggataaaaaaacaattaaaagattattaacatattgccaaccataccgtttgattttgatagggattcttgttttatcatttttaagtgtctgtttatcattgattacacccgtattattagggtgggcaatcgatttattaataggaataaatcaggtggattttaatgctttattaaagcaattaatgattattgtacttgtaatcgtagctggagctttagtgcaatggattttagggcagttgacaaataagatcacatatagtatcacaaatgatcttcgagatcgtgtatttgaaaaaattcacttgttgcctttaaaatatattgacagtcatcctcacggtgatattatggggcgagtaatcaatgatattgatttaattggaaccggactgttacaaagttttactagtttatttactggtattgcgacgattattggtacaatcataatcatgtgtttgattaatatatcgattgctgctgtcgtgattattttaactccattgtcattattagtagcttcattaattgtaaaaaggacacacatatattttaaagaacaattagaacttcggggtgaaatgaatggttatattgaagaaatgatagggaatcagcgaattatcaaagcttttaattacgagaaaacaaatgaagaaagatttaaagaaataaatcagcggatgcatattagtggtgttaagtcacagttttatggggcattgatcaacccaacgacacgtttcgtaaatagtctagtatatggagcagttggggtgtttggggcaataagtgttttaaatggtcattttagtgttggtttattatcaagttttttaacgtatgctaaccaatacactaaaccatttaatgagatttcttcagttatgacagagatgcaaacagctttggccgctagtcaaagagtatttagtttgttggatgaggcaatagaaactcctgtaactgatcctcaagtaataaatagtgttcaaggtaatgtgactttaaaaaatgtctcttttagctatgacccaaatgtaacattgattgaaaatctaaatctagaagctaaaccgggacaaacgattgctattgtaggaaagacaggctgtggtaagacaacattgataaatttattaatgcgcttttatgatttaaatagtggttcaattagtattgatggtataaatacgatagatatggaaagagactattttcgaagattatatgggatggtattacaggaatcatggatttttaaaggaagtataaaagcaaacataacttatggtaaaaatgatgctactgatgatgaaattattgctgccgctaaaaaggctcgagtgcataagtttatcatgaatttaccagatggttatgatacattaattgatgaaaatgggggcaatctttctcaagggcaaaagcaattaatttgcattgctcgaatcatgttgacaaaaccaccgatgttaatacttgatgaggctacgagttcgattgatactagaactgaattacagattcaggaagcttttgatactatgatggaaggacgaacaacttttattgttgcgcatcgtttatcaacgattaaaaatgcagatattattttagttatggataaaggaagaatcttagaacaaggaacacatcaagagttattaagaaaaaaaggatattattataatttatataatagtcagtttaatttaggaaagtgataagatgtctattttatcactttttaagttcaaaaataatttattttagtaataaattattatgttgacaaacaaaaattatgagcgtattctagtaaatgttataaaatagtatgaagggggaatattgatgaatggattactattattaataatttctatgatagcgctgttagtagcctattttggatatggacgttatcttgaaaaaacctggggtgtagattctaaagcaaaaacaccagctgtaaaaaatgatgatggagtagactttgtccctagtagtaagtgggaagtatttgcccatcaattttcatcgattgctggagcgggacctgtaacaggaccagtcatggcattaatgtttggttgggtaccaacagtattatggattcttgttgggggaattttctttggtgctgttcaggattttggagcattatatgcatctgttaagtctaatggaaagtcaatgggtggaataattgaagaatatattggaaaaacaggtaagaaattattctttttgttttgctggttatttacattattagttatcgctgcttttgcagatatggtagcaggaacatttaatggtttttcagcagttgatggatcaaaattacaacctaatgcagcagctgcatcaatttcaatgttatatatcgttgtggcaattgtttttggattctttttaaagaaatatcatgtaagtggtaaagtacaagcattgattggaattggattgattattttaatgttgattggtggaatcgtatgtccaatttatttaagcaaaaatacttggatctatattgtctttatttatattttctttgcatcagttacaccaatgtggttattaaaacaaccacgagattatttaactacatttttatttgtagggatgattgctgctgcagtaattggtgttattttttataatccaactatttcacttcctgcatttacaggatttaagagtgaatcaggcagttatttatttccaacattatttattacaatagcatgtggagcagtttctggttttcactcattagtatcatctgaaacaagcagtaaacaaataaagaatgaaaaagatatgttacaagtaggttatggttcaatgttattagaatcattacttgctattttggtagtagtggttgttggatctttgactcaattagtaagtgatggggtattaacagatcaattagcttcgttggttactgctgaaggagcaacaccttttactaaattttcagtaggggtcacagcttttgtttcaaaacttgggttacctcaagaatggggtatttgtattatgacaatgtttgtatcagctttagcacttacatcattagatgcggttgcaagaattggacgtttgtcatttcaagaattatttgaagtttctaattcacaagaagcttcaagtataaataagttacttacaaataagtattttgctacgattttaacacttttctgtggctatttattatcacttggtggctacaataatatttggccattatttggttctgcaaaccaattattagcagcaatggtattaatttcgttatcagtattcttaaaggttactggtcgtaaaggatttatgttatacattccaatgtgtataatgttagttgttacattgagttcattaggtatttcagtatacaatattgttaatacatggatgactacaggaacacttgatttcttgacatcaggattacaattgatctttgcaattttattgattgcattaggtgttttagtagcattctttgattttaaaaaattatttaaaacgaagaaaggtgcttaattgtttttaaaagtttataaataacaaataatgatgaacattatttgttatttttttaaaaattgacgtaagcgcttacaaatgatatcatgattaaagatgaagtgtttgcataaaggagggaaaacaatagataaaaagcaataaatcagggaaaatacgataaaattaatgcaaataaaaggaggatatttatgggaagaaagatttggaaaaaaataggagtttgtttattagtaatggtaatgacaattactggattacagacttttaaattaccagttgcagcggttggaaaaacaaatcttgagcaatctgattatgtagagggaacaataaagcgagctccggctactgctgatttagaagaaaatggaaatcttggctggattcattgtaatgtaaaaacacaatctcaatgggcaggatcagctataaatcagattagagatgttaaattagaaggtaatcttgctcaaattatgaatgatacggatacaaattttgtttattccggttcgccaagtgataatcataaaggacaggttatcaatggtctaggaggaatgacatcttttattttgccagccagtcttgaaaaaagatatgtatcggtatttactggatcatgggcatcacaagtcgaattgactgtttatatcaatgataaaatacaatattctaatattcatggtaaaacagcgacaacgagtggtgctgaaagttatttaacgcaattttcttattatacagataatgaatctgatgaagtaaaagtagtgatcaagacaatagaagtatttgatactacatatggtaaccaaagtattcagggaatcgctttatcagataaagaacagaattatggatcttctttaagtgagggattagtacaaggtgaattgataaaagcaccggaatatgtgaatttatcaaagcagggagatattgattggattcatatggattcagcacaatttggcagttttaatcgcaaaaatgtattagatgcagggattacagaaatgactttaattggtaattgcgattatgttactactaatgtagagacaaattttgtttatagtgatggaatgtctaatttaatgtctcctgaagtaaataaaaaaggactggtatttacaggagcaaataatggcttttcttttaaagtcccaggaagtgttgaaaatagatgtttagatatttatacaggagcatgggcggcggatattaaagtcactgtagaaatcaatggtgaagaagcttatgcagaaatctttggaagtaatgatactacagcaggaagtcctgctaaatatcaaactctgaaaattgattatcatactgacagtgttgatgatacagtaaaagttattataaaagtaaatcatacatacgataataactggggtaatatgaacattggcggtattacattgggaactcgccgcatagaagatgatggtagtattattggtggcataatgaaaactgtaccttcagcagtaaatcttagtgaagaaggaagtgttgattggttatatcttaatgatcctgtattaagtgagtataatcgtaaagatgtagaaactcatttaataagtgatgttactttgattgggaaagctcaaggaacaccaattagcgaaaaaacaaaaacagctttttcatataatgacgggataagtcctgtagaagaaaataatggtcataaagcttatgtgtttcaaggtgaaggaagtggaatagaatttaaacttcctggaagtaaagaaatgaaatatattaatttttacgctggagcatgggctgctgatgtaaaattagaagttttggtaaatgatactatacaatatagtagttcttttggaagctctagtactatacctgatacaactaattatcaagtagctagaattcaatatagaacatctcaagtaaacgatgaagtaaagatacgggctattgttacaaaaggatatgactctacttgggcaaatatgaatgttagtgcgataacagtatctaatgaagcaccagtaaacatagatgagacaattaaaacagataattggataattaatcatagtggtggtgagatttctgaattaaaaactaaaattgctgatgaaatgtataatattccagttcgtcaagatcagtatagcggttttgtatggacacttaatggcgaaaaagttattctttcgtctgttgatgaagatgatcagggaaataagatttacactgggacttataaaaataatgggaagaatctaacgtttacaataggttatagtgtaaatgaacttgatcagatggtagttagtgctgcaataaaaaacaatttagatgaagaatctaaaatagatcaggcaagtattcaactaggatttaatacgtatcttgaaaaatatccagattataacgatcaattattccctactttgataagatgtgaaaaaatacatgcctggggatatttatcaacgccatcaggtagattgatgacaattgcaactgatagtcctgttgcttcttatactttggattatcaaagtggtgctcatcgtatttattcggcatctttagatgttcttcaatctggtaagcttcctgaaagacatcctcaaggtttagataaattagcacctggtgaagagaaaacatggaatatttatttaaagcctgtaacaacattaaatgcaattgaggatgtaaaagaagtaatagccaaaaacactgatttaccaatgtttgatgctgatcggtatacattagctcaaggagaacaaagtcaaattacgattttatcaaaatcagcaattaaagataataaactgacgatagaagatccagaaggcaatatttcaaaattagatattgaaaaggaatctgatggtaattataaagctgtttttgaagctgctgataagttagaaggtgtttataaaataacagctgaaaatgctgagggttatatagctgaaatgaatctgagcattcgtaaagattggtcatggtatataaaaaaagcaagagaagcggctgtagaagcaccgcaaaaaggtacttcacacggtgaatcttattatggactatattcagcttatatagctaaaaaatattttccagatgcattatgggacgatcagattgatgaaaaatttgaagaaatatatcctttaatgtatgatgttgatactggtttaccaacttcatggcaagatcgaattcaaaatcattcgacaacattagggatatttgtagatcaatatcaaagttctggaaatatcgaatcattgaaaaaagctgaagtattggcagattttttgatgacaaaacaaaaagcagatggtggttattataatggcagcactgattatacctcagttatttatccggctaaatcaattatggaattagtttatgttgaaaaagacttaatggaggataatactcttagtgaaagtgatagagaatattatagagaacgttatgatttacatatggcttctcttacaaaggcaatggataagttggtgcgggtagatggtaattttgatactgaaggacaagcgacttttgaagatggtgctaattcatgttctattacacaactaagtgaatttgctcttatgttcccagctggtagtaaagagagacaaaaatatgctgaagcagcagaaaaatatatggagcgtcatacatcacatcaacaaagtattattccagactcaagaatgaatggtggaacattaagattttgggaagcgcaatatgatgtggaaatgggattaacatctacagcaccaaatatgatgaactcacctcatggctggagtgcatggagtatatatggcttgtttaacctttatgaattaactgggaatgtagaatatttagaacggggtatgaatgccatggggtcatgtgcacagttgatgggttatgatggaatattgaactgggcatttattgctgaccctcaaagagatacaaacttctttgtaaaagatgaagaagcatctatcgatgataagatcgtaggaaaacatgttagaaaaacaattggcgaagaatatgtaccaatgatcagttattggtggagagcaccaaaaaatacatgggtaccaggttacacagctatgggaggaagcgttgttcaaggagctgcctgcgataacgatgtccatgaagtgtttaaagcaatgggtgaagtagctttaacaaaagcatatattgtagaaaaagcagacggaacttttgaagcttataatgcagtagttgatgtaacagatgatttaattactatcactccttttgaagatgtggtttcaaacgtaagtgtaaaacttttaaatgataaaaaggtaactgttaatttttataatggtactatagaagaaaaggttttagctggtaatccagtctggatcgtaactgaagaaaatgcagttgatacaagtactcttgataaagatagcagtttgaaagatttagaggtaactagtggcaaattagataaagaatttgataagacagtctatgattattctgtggatattggagcacaagctggacaaattggcattaaaccagtatcatctagttcaaaagctatagtatatgttgatggtaataaagtagaaaatggggatacttatatagtaaaattagatagtgcattgatggagaaaaacgttaaaattgttgtaaaatcagaaatgcaagctaattctacaacttatacagttaaagtaacaagtatgggtaattgtaagatactttcaacagaaggacaaaaagcaattgctaaaagtcagcattcgacaagtggaagtgaagggccggcagcgaatgtgttagataataatataagtagtatttggcatacaaattatagtggtggaatagttgatataaaagatcgctggatcgaaattcaactagctaatgaagaaacagtatgtggagtacgttatttaccgcgacaaagtggtgacaatggaaaattcttaaaatatgagatctacattagtaatgatgatggagagacttatgaaaaagttctacaaggagagtgggataaatcaaatgattggaaagtagctgtttttgataaagtaaaagcaacaaatgtaagaattgttccgatagagacttcaggagagtttggaagtgcagccgaaatacgaatagttggtattaatgaggaaataaataaagcacttttaattgaaacgattgaaacagcaaaaacaattaatttggattattaccaagatggtgttgaaaaagctgatttcataacaattttagctaatgctgatatattgttagaaacagcaagtacacaatcagaaattgatgaagcagtagctgcactaaatgatgctattaaggcactgattcctaagactgttgataaaacagcattatcaattgcagtagaagtagcaaacaatgtaagtgaagaagaattagcaaaagtagtaccagcagtagcaaatgaattcaatgtagcattagaagaagcaaaagcattattagcagatgctacagcaagtcaagaagcagtagatgcatcatttgatcgattagcaacagcaattcaaatgttagactttatcaaaggagataaagcagcattacgttcactagtaaatatggtaaacggaaaagatgaagcattgtatacagaagcaacatgggaagtatttgcagcagcattagaaacagcaaataatgtcttagcagatgaaaatgccttccaagaagaagtagatgaagcatataacagcctagcaagagcatatctaagcttaagattaataccaaataaagatgcattaaatgacttgatcaataaagcaaacggattaaatgcagcaagctatagtccagaatcatgggcagcagtaagcttagcattagaaaatgcaaatacagcaatggcaaatgctaatgcaacacaagaagaagtaaatgccgcagcagaggcattaagcagtgcaatcgaaggattagtagaagctgaagtatcaagtgcatcagtaaacgaaggtgtaacaaacacagcagtaaaagcaggagatacaacagcaagtatcaagacaggagatagtgcaagcttaggatactcagtagcaggattagcattagcaacagtagtattagcagcaaacaaaaaaagaagagcacataaataaaaaagtgcaataagaaaaagcatgaaatttaaattcatgctttttctatgtattaatcaagctaatttgatcagcttatttaactatcatgttatttgtttaaagcagtaaccatatcttctgtgatcgaatcaaccatttgtaatggagttacaattaattcaatatcaattttttcacaaatatctaccactgccgcccaaataattggatttcgaacaaaaagacgactaggctttccagtttttaaaatatagtctactaaaaacgataagactaaactaatttcatcatcttcaggatcaagtaaatgagttccgagaatcatttgcgattcttcatcaagaacgataaacaacaatgaattaattggtcgcggataactcttatcagagatagaaatatttaaatatgttaaatccataataagaccatgattattgtcagatgccgaatggatttgttgtaaaatctcttcatcatctatttcaattggagtgaatttatcaaatgcctcaggtaaacataaaggctcatagaaccattgaccattactttggtaagcgttaataatttcttcttcattaaatttaatatcaatttcatgattagcataggctgttacgatttcgattaactttttgattactttaatgaaaatctgcgcttgttcatcattgatatgatatggaaaatatcttttcttataagatataaaatatggccaattaccacggccgcgaaattttaatcccaattctttaatgatctttttttgttgagtaggaacttcttcacgatctcccatatagaaagttaaacacgtttgatcatacattaaatattttgttactgatttgtcgataggctcagcagtaatagacatcaagtcactataaccttcatcacctgtgtagattgaaataccaatacagtcattcatttgtcccataatagagcagtaaaaactatcttcattttcaaaacttattttgatccagtcattacttccaatatacgtccatggttttatttcgttccactgttggataactgtatataattcttgccaaacatttaaattacttttcatttatattacctcgctataattctattgtacctcatattattataaaatagctacaaaaatagcaattaaaattgcacaaattacatcacttatataatgaacaccacataagattctagaaaaactaacgataaacgctaaaataagcattatgatgcctaaaggcagatacacatttatacaggctaaagcaatagcaaatgcactaacagtatggcgactaggaaaagattcaccagctttatgcattaataggggcttgatattcatagcttcataaggacgtttacgatttatgatctttctaaaaatagtaacaataataaaagagactaaaggttttattattgttgcaagtaatagtgtgctttttgttataaataaataaattaaaatactaggataaatgataaaagtaatgattggaatatatttagtaaagttaataattgtattttttaaaattgaatggttacgaatttgttgtaacatattttgataaaatagttccatgataactccttatctttttaagattaaaatagttgtgccatcattcatagttagaattttacgaagtatttttttatgtttatattgttttcttacatagttttgtaaaatcttacttgaatagccatgaatgactgtgacttcattgatcaaaggattaagactgtttaaataattatctaatttaacttttgcttcattagttgtacaaccatgaatatcaatttgattaaacattattttcctcttttcttatttgatataacggtaatcgttatatcaagtatatattaaaaaataggaaataaaaagaaaaataattataataaattattttagacattgcaggaaagatgatgaaattttataataaaataaacaaacttgcttttttacaatagattaagtagaatataagagcatatgaatggagtgatatagatggcattaacagcaggaattgttggattaccaaacgttggtaaatctacattatttaatgcaataacaaatgcacaagtagaagctgcaaattatccgtttgcaacaattgatcctaatgtaggagtagttgaggtacctgattatcgattagataaattaacagaaatgatcaatcctaaaaaaacagttcccacaacatttggatttacagatattgctggtcttgtaaaaggggctagtagaggtgaaggtttaggaaataagtttttagggaatatcagagaaactgacgctatctgcgaggtagtaagatgttttagagataaagatgtaacccatgtagatggtgatgtggatcctatcagagatattgaaactattaatttagaacttatttttgcagatttggaaacggttgaaagaagaattggccgtttaggtaaaaaagctcagtcaggagataaagatgcaaaaattgaaattgcgattttagaaaaattaaaagcagcgcttgaagctaataaatcagctagaacaattgatttttcaaaagaagaaatggcaattgtaaaacaatatactttgcttacgatgaaaccaattatctatgtagcaaatctaggagaagaagatttagaggatccaaagagtaatccgcactacaataaagtagttgaatttgcatctagtgaaggtgcagatgtagtaccgatttgtgctaagattgaaagtgaattggtaggaatggaaaaggaagataaagatctgtttttacaagatttaggaatagaagaaagtggtttagataaactaattaaagaagcttataagttattaggtctaagaacattttttacagcaggagtacaagaagtaagagcatggacttttaaagaaggaatgtgtgctccagagatggcaggaatcattcatagtgatttccaaagaggatttataaaagcagaaacttatagttttgaagatttggttgaatatggcagtgaacatgcattaaaagaagctggtaagattcgacaggaaggaaaacaatatgttggtcaagatggcgatatcatgttgtttaagtttaatgtataatggctagagaaaaaaagagctttgttgaaagaataaagccaaccggatttaaggatttaattagaaaaatcattttattagtatgtgtttgtgtattttgttatagtgcttataatttggcatcaattttactagaatataaacagatggatgatagtaataaaaaaatcgaagagacatatgtaacagaagaaacaacagaacaaggatcatataaaaaaattgatttcgatgctcttttaaaaagaaatcctgatgttaaagggtggatcgatatccctgatacgaaagttagttatccaattttacaaggagagactaatgatacttatattcatagtgatattgataaaaaagaatttagagctggttctatttttattgcaagtgaaaatgaaaatccgtttgcagatttaaacacagttatttatggtcataatatgaaaaatggttcgatgtttaataatatcaagtcatataccgaccaagattttgcaaatgaacatccatatatatacatttatttaccagatggtactgtaagcagatataaggtagtggcagcacatattattcctgaaaaaagtgttctatataatacttcggtaactgatattcagtctttttatcaggaaatgttaaaaacgagcagtattaatgttgattttgatcaatctttatcaaatccagtaattactttatcaacttgtacttctcaaggtagtgaaagtggtaaaagaaatgttgttcatgctgtattagataaagcaggaattgatccaacagttgaaaagatggatgagtaaaagcatagacgggttacgcctatgcttttttagatgcgttttatttgaaaattatataaggaatgaagtagtaaaaagaatttgtgattaaaaagtttagctaaataaggattattttgttattatttgacgaatttggatattttaggtatcatagggtaaactaataaggagttgaggtagacaaatgagaaataataagtttttaagatttttaacatcaaagtattttattttagggattcagttaattatttcaataactgttgtttattttatctttaaacttaatttagttccgacaaagtatctaattggaattatagctggattattgatattattgtgcggtttttttggaattatttatagtggggaaaaaaaggatcctgtaagtaaaagaagtgggattacgaaagttattagtttattaattagtatcattttagtaattggctgtacgatgatttcacgtggtgatagattcatcgataaagtaagtgatgctacaggacaacaatatgtaatttctgtaattgctttaaaagatagtgatattactaaaaagactttaagtggaaaaaaatttggtgtaacttatgaaaaggattcaacaactctaacaactgctctgaccgacatggaagatgaaataggtgaacaagaatatcaaaagtatgataattatatagaattagcggatgctttatacagtggagaagtcgactgtatcgttgctggtgagcaatatcgaagtatgttacaagttaatcatgaagcttttaatgatgaaactaaagttattacttcatatacctatgatgccaaattagaagtaactacaaagaaaacagatgtaacagaaaagccattttcagtttatgttactggaattgatgtttatggcagcttaaaaactgtatctcgtagcgatgttaatctaatcgttactgtcaaccctaaaactaagcagatcttaatgacaagtatacctcgtgattgtgaaatagagttacattcaaatgggaaattggataaactgacacatactggtaattttgggacaagcgaaacgattaatacaattcaagatttgttggatatggatatcaattattttgtccgaacgaatttcagtggaatgactaatatagttgatgctctaggcggtataacggtggaatcggatgaagattttatcacattacatggtaattatcatattactgaaggtttaaatgaaatggatggagataaagcattatgctttgtaagagagcgtaaacatttgaaattaggtgattttgcaagaggacgaaatcaacagaaagttttgaaagcattgatggataaggccttatcaccaaagatcattactaattttgataatgtattaagtgctcttgaaggtacttttgaaactgacatgtcaagtgatgaaattcgctcattattgaatatgcagcttaatgatatggctgattggaatattataaatgttcaaattgagggtgaatactatgactgctatgagacatattcaatgtatggaactaaatctgatgttatgaagccttttgaaagccatatcgaaagagttcgtgaattgattaataaagttgaagagggcaaagaaattaaagatagtgaattgaagggattaacacattaggggcttaatattcgagctccttttttattttatttttttataataatggtataataagattaataaattggagagaaaagaaaatggtttttaatcgcaagtactataaattatgttttattatatatatgtttatcaatactctggctttaggttattttggtattgaaattaattatttgtttttaccattattattgtgggcagttataattgttatccatgatatttataaaaaagaatttggaataaaaaataattacagtatcttgatgatgattcaaggaattgtattgttgattgcaacattaaaaaacagttatagtgatttaaattcatatgtaattgcaatcatgcagttagttatatatttcttagtttttaataatcctcggtcaatgaccaaaaaaaatattgttgatgaagtaaaagcgattattcctcttgttaatgttttggttggattagcatcaataatttcaattggaatgtatatagttcatttttctagcctagctaatggctggaccctaggaatggttggaagtcgtttgtttggtatttattttaattgtaatccagcagcttttttagcgtgcattacaattgtattggcgctaattgctgtgagagagaaatttcgaggtaaattctggtatttaatcaacatagggatacaaattgtttatattcttttgacaaaatgtcgtgtagcattaataattttagttgttataattatcatggtcggctattattttttaattcgacgaagaccatatactctgtttaaaagattgatgttagtatctggtttagtagcagtaattgtatcagcaagtttacttggtcaacagcttgtagagatcgtaccgcaggtgcaaggaattgcttcaaaagagacaagtcgttttcaaatggataaaatcaaagaagcagggcgcttattaatatctggtaatattgatgattttaataaagggttgacaataattgatgaggtttctaatggacggatttcattgactaaaacagcgttagaaatatggcatgatgagcctttgattgggattggcgctaataattttaaaaaaattggaagccaggaaacagatgttattgaatattgggcagttcaggttgttcatagtcataatgtttttcttgaggcgttagtaacgacaggattaatagggtttattttgtttgtaatattttttattaaatgtgttttaatgtgttttaatgttttgaaaaaaagtcatggtaaagaaatatatttcattattcagatgtttgtaatgattgttttaagtgaatttataggtggattgtctgattatggagtgttctatatatattctttatcagcaacattagcctggtgttttttaggatacctatttacatatcaaaatattatagaaaataaaaatgagtcattggaaaagtttagtaatgattagggagaaaagaatgcgagtagaaaatattttatttcaattagatattagctggaagctatttatagatcatgttaaagatttaacggatgatgaagctttatggtgtaaagaacaaaatggtttacagattcgatttttagatggaaaatggcaagtagatcattcgcaaaatgataaatatcatgaatcagctagtgcagcatggatgatatggtatactatttattggtggcggaaggttctagatcattcgtttggtgagggtaagttaaatatagaagatgttcagtggtcaggaagtgtaaagcagagtattgaagaagtcgattatctacatgatcagtggatcaaaaaattatctggtttgacccttgaacaattacaatcaaagcaatatactaaatggcctttttcaaatcgaagtttttatgatttggcgctatgggtaaatactgaattgatgaaaagtgcagtcatgataggcacttgtcgatatttttataaaatttcaaataatgattaaaatgaattcaaatctatttaaaagatttgaattttttttaattgatcttgtttaaaacatttacatttttctttatattatgaaagcataaaagttgacatctttcgacattagtatataatgttagcaaactaacaaagttggagaaaaatgatggatgaaaaacatatcggaatggaaataagaattttagcaaatatgatcagtcgttgtttaaatgagattggctttagtaaagaacataacaatttaactgggccgcaaggactggttttgggatatctttgtgaacatcaaaataaagatatttttcaaaaagatattgaaattacatttaatattcgtcgttcaagtgcaacaagattgttacaatgtttggaaagtaatggatatattgaaagagtcaacgttggttatgatgctagattaaaacaaattgtattaactaataaagcttatgaatttagtaatactttagaagcacatattcaaaagcttgagaaaatattagttaaagatttagatgaacaggaaatcaatgattttataagattaatgagtaagataaaaaagaatttagagtaggagaacaaaatggaaaagaattattacatgggaattgacgttgggtcaactacgataaaaatttatattacagatcaagatgataaatgtatttattcaaagtatgagcggcattattcagatatacaggctacaattaaaacattaataaatgaagtattagcaaaatttggtaatcttaaaataactgctgtaatgaccggatctggaggattgtcactttctgaatatttagatattaaatttgttcaagaagtaatagcatgtactaaaacaatcgaaacatatatacctgaatgcgatgtggctattgagttaggtggagaagatgctaagattacttatttccaaggttctttggaacagagaatgaatggtacttgtgcaggcgggacaggagcttttatcgatcagatggcatcgttattacaaactgatgctaagggacttaatgaattagcaaaaaattatcagatgatttatccgatcgcttcacgttgtggagtgtttgccaaaacagatgtacagcctttgatcaatgaaggtgccaacaaagaagatatcgctatttctatttttcaagctgtagttaatcaaacgattagtggtttggcttgtggaaaaccaataaggggtaaagttgcgtttttaggtggaccattatttttcttggatcagctaagacagcgttttatagaaactttaaatcttaaagatgaagatatcatttttcctgataattcacaattatttgttgcgatgggagcaacgttattagctaaggaagaaacaagtataacggatattgaaacgctgattaataaattagaaaatattgatgatagtatgttagctaatgaaaatacattaccagcattatttgtagatgatgatgataggaatgaatttagacatcgtcattatattgataaagttagaaaaaatgatcttaaaagttatattggtaatgtatatttaggacttgatgttggatcaacgacaactaaagcggtattgatcgatgataacgattcattattatattcattttatgattctaatgaaggaaatccattaaacgttgttgttaagattataaaagaaatatatgatcttttgcctccaaaagtaaaattagtatatagtggtgtaacaggatatggtgaggctttgattaaagcagcgatgaaaattgatatgagtgaagttgaaactatggctcactacaaagctgctacatattttaaaaaagatgttagctttatcttagatattggtggacaagatatgaaagccattaaaatcaaagatggaatcattcaagatattttattaaatgaagcatgttcaagtggatgtggatcttttattgaaacatttgcaaaatcattaggttatgaagtaagtgagtttgctgctttagcattgaattctaaagcaccgatcgatcttggaagccgttgtactgtttttatgaactctaaagtaaaacaggctcaaaaagaaggagctaaagttgaagatattagtgctggtttatcatattctgtaataaaaaatgctttatacaaggtaatcaagcttagaagtaaagatgatttaggtgatagtattctagttcagggaggaactttttataacgaagcagttttaagagcttttgaaaaagaatctggagtcaatgcaattcgtccggatatcgctggtttaatgggagcgtttggaatcgctcgattagctcgagaaagttatcaaggacaaccaacaacattactaactaaagaggaattagaacagttttgctgtcatagtgaaataagatattgtcaaaaatgtacaaatcactgtatgttaacagtatctacatttaatgataatagtgaatatattagcggtaatcgttgtgaacgaggtgctaatatacctgtatctacaaagaaattgccaaatctatttgattataaatatcgtcgggtcttcaattatcgttctttaaataaagaacaggcaattagagggaaagttgggattcctcgtgtcttaaatatgtatgaaaattatcctttctggcatacttttttcactaaattaggttttagtgtagttttatcaccacgttctagtaaagcaatatatgaaaaaggaattgaatcgattccttctgaaagtgtctgctatccagcaaaattagctcacggtcatattgaagcgttaattgaaaaaggtgtaaaatatattttttatcctagtttagcatatgaacgaaaagaatttgataatgctaataatcattataactgtcctgttgtaacatcatatccagaagttattcgaaataatgttgataacttagctgatagttcagtaatcttccgtaatccatttatggatttaagtaatccaaaaacattatttaataacttaaaaaatgaattaaaagcattttgtattgatgataaagaattaaaggcagcaattaatgcagcatatgatgaattagcaaaatgccgtaaagatatccaagaacaaggagagacagttttaaaatatatcaaagaaaataatttaacaggaattgttttatcaggaagaccataccatgttgatccagaaattaatcatggtttagctgatttgattactgctgaaggaatggcggtattaacagaagatagtatttgtcatttagataaggatctagatcagttgcgggtagtggatcaatggacttatcattcaagactatatcgggcagcgtcatttgtcgcaactcagcctaatcttgaattgattcagcttacttcatttggttgtggtttagatgctgtaacaagtgatcaagtagctgatattttaaaagcacgtcataaaatatatacattaataaaaatagatgaaggtagtaatttaggggcaattagaattagaattcgttcacttaaagcaacgattgaaaaacaagctaaaaataaaaaacaaatttatcctaaatatcaaccattaaaagttccatttacaaaagaaatgaaagaatcaggatatacgatcctatgtccacaaatgtcacctatacattttcagtttgttgaaacagctatgcaagaatcaggttataacttagtagtcttgccttcggttgataagggagctgttgatgcaggattgaaatatgtaaataatgatgcttgctacccaagtattttagtaacgggtcaaattatggaagcattattgagtggtaagtatgatttggataaaacggcagtaattatttcacaaacaggtgggggatgtcgagcaactaactatatcgcttttattagaaaagccttacaagatgcaggaatgccgcaagtaccggtaatttcagctaacttacaaggacttgaaaataatccaggtttcaaaataaccttaccattagctaaaaaagttattattggggcaatgtatggtgatttgtttatgagaattttatatcgtgttcgaccatatgaagcagttgctaatagtgctaatgaattatatgaatcttgggtaacacgttgtcaggaagatgtaaaaaatggtaatatttctacttttagaaaaaatgtttatcaaatcgttaaagaatttgatgaattaccaatattagacataaaaaaaccacgagttggtttagttggtgagattttggttaaattccatcctactgcaaataatgaaattgttgaaattattgagcgtgaaggtggcgaagctgtaatgccagatctaattgatttcttccaatactgtttttatagtacggattttgaaaataagcattttcatgcatctaaaaatgcagttagactttgcaatcttgccatgaagtttgtggatctattgcgtcatgatatgattaaagcattaaagaaatctaaacgttttgatccaccagctgcaatcaaacatttagctgataaagcaagtacgattgtttcaattggaaatcaaacaggtgaaggctggtttttgactggtgaaatgattgaattaatagaatcaggagctccaaatattgtttgtatgcagccatttgcttgtttaccaaatcacgttactggtaaaggagcaatcaaggctttacgtaaggcttatcctgaaagtaatattgttgcaattgattatgatccaggagcgagtgaagttaatcagttaaatcgaattaaattaatgttgtcaacagcatttaaaaatatgaaaaataatgaaaatcaataaaattatttatttaagagcatagatcatcctatgctcttattatttttcttgaatattaaaaaagtttggattgatcatatatttttgtgttatatttttaataagaaatataaaaataaagtaggagataatatgatacagtatgagaaaatagagcttgattatgatttaccgatcaaactaattgatttatattttgaagatcatcttactaagactgcaaaacattggcataatagtattgagattttaataccgatattaggtgaattgaggctgtatatagatacaagagaaattattgttaaagaggggaccttttatattgttaatacgcaagaaattcatggtatagcgcatacagaggaaacagaaatatataaaggatatgcattgcaaataaattatgattttattaaacagaattttagtgagatcgataattattattttatgcaaccagatcgtcaaacacaacatgaggttttaaaagatatttatcatataattcttgcttatgaacatgaaaataattttaaagatatagaaataaaaagttatattttacatcttctttacattctttttgctcaaaccttatgtaaacgcaaagactatccttttatggttcaatcagaacatgacaaaagaattattagaataacaaaatatattgatgagcattataatgaagatttatcaattggtcaaattgcagatcattttcacatatctccaggatatttatcaaagtattttaaaacaagtttaaatatgactgttaaagaatatatcaattcagtacgtttaaaaaatgctcgtaaagatctattattttctgaatattcaattattgaaatttcatatctacatggttttcccaatttaaaatcatttactcaaattttcaaaaaaaaatataattatacacccgctaaatatagggataagatgagaaaataacctcaattaggtgaagatttaacatttattaaaactttttaaatgttaaaataacaccgaaaaataaggaggaagagaaaatgataaagaaaattttaagttgttttgtatgtgcctttatgttcatttcaacaatttctatcgttcatgctgatgaagaagtgttgattagcgaattatattagataacttttttcagattaaattagttatttttgaaatgcttttttataaattaattataatgatcaaattattttattataaatattataaaaacagtctaattgatatttttataatatcaatcagactgtcatttctactatatttctatatcaaatattgtttcagatttttcttcacatcctgataatatttttaaatatcctgctatatcactaagtctttcttctatactgcttagtaccctgtatagttcaatttcaaaacacccatccttaggaacgtacttttcttttagatattctgccagttctataaaatcttctgcattcatcttatctctctcctcatttaaaaaaattatcgataattttaagcccattggctatagttagaccatctattatactgctggtatgttctgccagcttttcactgttccagaagatatcatcaagacagctcagttcacttgagatccccatctctggaatatccagccatcttgttttaccgaattctatcagatacacacgataaagactcccttttccacttactgtaaatcccgttatctgctttgtttgttcgatatcttttattctgcatttccatctcatatttttatagctgcattcatatatcagttcttttttatccgatttcatctgctgcctccattaccgtatcattatcgatcatcatcctgtttgctgctgctccaactatcaaacagtgtgtcatcagattgtttagttttcttgatgaaccctgacaggcatttgacagcgccgtcaatgcttccggcatgaccagcggttcattccttccggctttttttaattttatctttatataattttcaatatctttctcattaatcccggttgtttcatactgaatcacgatcctttgcctgagtgcttcatgaactgctctattgaccgtatgatttaatactggtgttcctgtcagaatcagaatcacataactgctcgaatcaaaattaaaattcaaaagcattatcagatcgttcagaatctctgttttcaaaaattgaccctcatctaatattatgaccggcacgatccttttctcatcgaccatcttttttatatgtgcctggatatttctgaaattatctatttttttatgatatatttccagtcccagctgatggctcagttcacgatagaattcgatcgtgctcagtgttgacattggcatatatattactttatatagaccaggattcagtgtttcactgaattttttcattataaacgatttgcctgtcccgcttcggccggtaaacaatcctatccctctgacaccttttagataatcgagccttcccatagtgttattcggtggattattttaattaaaataacagctatttagtcaaacaaaaataataaacctagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacaccatagcttcctgataatcactggtatctaccggtatatcaggctgtcccttttcaaatggattgaattcaagtccataatagatcttaaaatctttcattggtcatcctcctttgaaaacagcggtcgctttctttttattctggaattgtctactttttttacttcagagatctttatataacttttatcatcaaatatataaacttcactaagatcaggtttatatttgatagttattttgctgcctatatactcctgttttgtctcgtaaacttttgtattgagtctgatcgttgcatcattggcaacttttctgactgcagtatgataaaatattttttcaagcttctctggttcgacccttctgatcgatgtttcatcatccataaaaacatttactggagtgtttccattcagtgaagcatgtggtgaattgtttttcttattgacatatagggcaaaagctgaatctatatcttcgatacttttgaactgattaaaatcagtattgtacatccactgctcttttactgatttaaaggctctttccacttttcccttagaattgccatggaatacctgagcatgattgatctggatctgcagctgagcgcagatgatcggtaactgttcgtttttgtatggttttccattatcggcatacagtctttttggaacaccatatttagctattgcccgtttcagtactgtctggacattgacagcgttgtcttcaaggaagaatccatatccaactatcattctggaatggtcatcgatgatcataataagataggttcttgatctatgacctctgctgtctttgatatatgaacagtaggtagtatccagctgccacatatcgttgctatgctccatttcaaatgctctcatatcttcgatcgggacatgattgaattccggttttgatccaatgaatcttgttatggtcgataatgagatatctttctttaatatatctccatcctcaatgagcttcaaataaacagaagttgctgtcatccttggattcgtttttttcatttccatgattttgtttttcaaagttttattcagttttcttgaatgtcctttgtcgctgcggttttttggcatcagtccactaaatccttctttttgatatgtatcataccagtatcgtatcgtttgaaatgaatattctcttgatgtaccatcaggatacttcaatggattggacgcgatccttttataatactgcagcgccgaacgatctggataggttctgttaagaactggtactatcagttcatatctaaaaagtgcgatcttagtatccagatcatcttttttactgttattcatataaaatacacctcctgacctaaacatataacagccggaagaaatattcaaagtaacagttatgggaaaataagtttatgtataaattgtcatattgttgactgaaatacgctgcataaacatggtgtgatattcgtaaaagtaattcagtataaaatcaaagtcataaagatcagatactctaaaaacactcaaaaatgaatcgagtcttttctgatggaagcggatataaaacctgatgactttttttactgtttctctggaaaaaccggttatttttgaaataacagaacatgaatgcgtgatattgcgataagacttgattattctgattatcgatggatttgataatattcgatagggaataatgatactgggaagaagagcgtgtgtgcaaccgcagctttcgcatttgatcctaacgatagaaatcagcagcgtatggttggaatcaatagccagataacgctgatagcaggcatgacgatgaaaatgtccagtagaaccgcaggtacatttaaatttattaagatctaatgatcttacatcattatcataagagttttgagaataattattgaaagaaagtgttttaaatgttatcattgatgtgtacaagacatacataatgttttggggaaaaagagaggtaggactgcaatccaatgatcctttcttttttgtatgccgatctccttaaacataataataaaacagttgagataatttgcatattaatttatcaaattatttcagctgttttttatatttattaatttaatttgatttgttcctgtctttttttgtttatataatgtgctaatcaacagaagaagttgaaatcaatggtacatatagtatttatgttgaggggtatgattggggatgtgccactaaacaaattattgtttcattggatcatgaaatagatgaagtttctacagatactttcaaagttgtagaaacaactcaagaaacagcgatccctctagcacaaaaagatgaagaacgtattgttgaagatgtatatttaagtgatgctagtggaaatgaagtagatgaatcatcaaaatatgtaacattagatttagcagttagtccaactgttgcttcacctttagtatttacgattcctgatttgtataataattatgctaatccatattattttacaattgaattagctcaagataaagcgcttacttcaaatggtaaagttgtaacatcatttaatattgataaagaatatactaaaaaatcaacagctgcagatatgtttaaacaagctacttttcaagcaagcgatggtattagttataaatatgcatcataaccttacattcctttccgcctgcgtctccaaggcacacatagtcatgaataaagtcttgtttgtgcaggcattttattttatatttttactgaaggagtcttacactacaaagcacggggaggtgagttgtagatttctgcaactcgttcagttcaaaacagtatcataaccagtgcagggctgaacttttcaagcacacatgagtatgtcttttgagtctgtagattaatcattgacttgagttaatcttttagtgttgttcagtcagtcactgagctccttctctatattctgaaaggagctttttatttatggaaatcgtttaccctagagcctgtggcgttgatgtgcataagtctttcattgttgctgttatctgcatctctgaatccgtcaaacccaggtatattaaaaaaagattctcaaccttcaataaccaactcattcagtttagacaatggcttatcgataacaactgtcaaaatgtatgcatggaatccactggtaaatactatgtccctgtatacaatgcattggaggaccacatctccaatgtcgttgttgccaatcctaaatgggtcaaggctatcaaaggtgagaaagatgacaacaaggatgccaaatggatcgctgatctctttaaattcggtatcgtcagatctagctatatccctgaaaagaatatccgtatcctcagggaatttactcgctatcagttcaagcttgtcaatatccgttcttctgagaagaatcgtttccaaaatgccctgactgttggaaactgtaagattgatcttgttttttctgatgtctttggtaaatccgcttcctctattgtcgatactattttatcagatgaaccctataccagtgaagacattctttctaaagttcatggcagatgtaaatcttctgatgaagatattctcagtgctgttgaaggcactgatttgaatcattatcagaagtcaagaatcagaatcgttcagaaacatatggaatatgttgattctcttcttgatgagattcagcatcatattaatataatggtctctgcctatgaaaactatatccagcttcttatgactattccaggtgtcagtagaaaatctgcaattatcatcatttcagaactgggtattgatgtatcacagtggtccagtcatcgtaagcttgccgcatgggctggactcgcacctggctgtaacgagtctgctggtaaaaagaaatcagttaagatttccaaggcaggtgtttatatcaaaccatgccttgtacaggttgcacacgctgctgtcaaagacaaaaattgtgattactatgcagacaaattcagcaggatttcaaaacgtcgtggcaaaaagcgtgccatcatagctattgccagaaaaatacttgtagccatctatcacattcttaaaacaggtgaggttttcaacccatctgatatggcagacgtagaaacaacaaaacaacagcgtatcgaatacatcaaaaacaatttaagaaatgctttcaatcagctcagccgcactggtttgagtgatgaagaaattctacaattcattatcaagaaatctagcaactcacctcagacagaatagccttccatttggggaaaggggctttatgcacttttttaggtaaaacattattttccgttcttattttttattcagattatctctcatttcaaactgataaatattaatagcaaaagctatcaatatagtttttgcttaaattttgtattcatacaaaatttaaaaatatatataatagttaaacaatctatttttttgagtttgatactcttaaaaatcaggaaaactattaatatataattgataaatatgagttataatatgtaaaaaataatagttattgattttgataaaatatataatgaatcttattatagatgatataaataaaggaggaatttgatgtatcgatatatgggtctaattgctattattccaggagttatttattttacattttttattaatcgttttatgcgttcggttttaaatattcacactaaccgattttatctcattatattagctataatcgttacaatagtttctattccggcaatgaatacgcttgaattatatggtgtgatttattatcatttattagttattacactaatattagaatttttgaatatttggttacaaagatttaatatttatcgatttacttttataacgggaattttgggagtattagtaacagttttatgtctaggatatggatattataatattaagcatgttgtagctactacttatgatctatcaagtgataagattgatgatctaaaaattattgagattgctgatttacatatgtcaacttctctagatgttttacaattacaaaaatattgtgatgaaatgagtgaattaaatgctgatttagtggttttaactggggatatatttgatgaaaacacgccattagatgatatggttgatgctagtaaagctttatcaacaataaaaaataagttaggcatatattatgtgtatggaaatcatgataatggttctcgtaattttgatgacgtggcatttggaccagaagaaattaaagaaaacttagaaaaaaatggaattacggtattagaagacgaagtaataactttagataaaataaatattattgggcgtaaagatgcaagcttttggggaaataacccgcgattagcaacctcagagttattagcgatgattcctgaagataaacgtgataattatacgattattttagatcatcagccccttgatttagatgaaaatgctgctttaggtattgatttacaattatcaggacatactcatgggggtcagttatttccgatggggatagttcaatctcttactagtgatactttgattcgagggcaaagaactatctatgattttacagcaattacttcttcagggatggcaggatggcgctatccaatcaaaactggggcaccaagtgagtatgtaattattaatgttaaataaaaacatccgagaggatgtttttatttagataaaatttctacacctgtttcagttactaaaagagtatgttcccattgtgcagaaagactaccatcttctgtatatacagtccattcatcatcagcgtcgacaaaaacatcacgattaccaagattcaacattggttcgatcgtaaaaaccatacctggtacaatcgtcacggttgattcatttggttcaaaatgaaacacatagggatcttcatgaatggctaatcctactccatgaccacaaaactctctgacaacactatatccgttagcgttagcgaaggtttcaatagctttaccaatatcaccgatacagctttgataaggggtaatggattgaattcctagttctaaagcttttttagtatctttaactaatttttcagcttctttagatgttttaccaattataaacattctcgaagcatcagcataatagccatctaccatagttgtagcatcaacatttacaatatcaccctcttgtaaaatttcttctttacaagggataccatgacaaactacatcgttgatggatacgcatatatgtttgggataaccgcaataatgataatcagcacatacagcgttgtgtttttcagtgtattcttttgccatgatgtctatttcttctgtagccatgcccgctttgatgttttcttcaatgtaatctaataaccctgaattgacaacagcagccttttttattcctttgatttgttcttcattttttatcattttatgagtcgggatttttttaccttgatgttttaattgttctagtttttcatctaattgaagatgacatttcttgtattttttttgactgccgcaccagcagagatcatttctgtttaatttcatacttaaccttctttctacacttagtatagcattttatttattgatttaaaactatttattagcctttgctaacctaattagatcctccttttgttttctcgttaattgtttgattgcatgttcgcgctttaaagcaaggctcttgttttctagttcttcaaaatatactagacttacaggacggcgtgatttagtatatttggctccttttccactgttatgagcaataattcttttttctatattagttgtccagccggtataatatgtattatcagcacatttaaggatataaacataatttttcatatctccattataacaatatttgtattttttagatgacatattttttattttggtttatgattagggccaaagaggtggtattgtggttgattttaataatttgatagatttgcaaatagaaatcttttttttaatgatcgtaggatatgttttaagaaagttaaatattatatctagtgcaaaccgaaaaagtttgacagatttagttatatacgttattttacctgctaatattatatattcttttatgattaaaatggatggagaaattattagaagtggcttaacggttttgatagtttcaattgtaattcaattaggatgttcttttttgggaaaatatttttttgttaaaacattacctagccagcaaagtgttttgcagtatggaacgatttgttctaatgcggggtttatgggctcacctttggttcaaggtctatatgggtcaaatggtttgttatttgcttcaatttatcttatcccccaaagaattgtgatgtggtctggtggtgttgcttgttttactagtgcgaagggtaaagatgtaataaaaaaagttattacgcatccttgtattattgctgtatttattggcttgatcataatgataagtcaagtgcagctgccaaattatttagatatttcaattaaagcgttgagtaactgtaatatggcgttgtcgatgattgtaataggaggaattttagcggaaatcagcatcaaagaagtcatcaacaaattaactttttattatagttttattcgtttgattttaattccgttattagttcttttaggatgtgttttgatcgatataccaccattagttaccgcagtatctactgtgctggcagggatgccggctggtacgacaactgcaatattagcagaaaaatatgcgggtgatgcaaaactagcagttgaaatagtttttttatcaacagctttatcattaattacaattcctttattatgtattatcattaatttagttgtttaaaggggctgtaacgaatgaatagtttttggctattcattcgctttttttatctaatttatagaaagtaaattattatggaaagtaaccagaatatatgttgatatattaatatattcctcattatttactttccataatattatttatttaaatctatccagtatagaagtaattactaaatcatcttgtttaatttcattctttttatttaattcaagtttgtcagtacgctctattattgctttttgtaatatattaatattagttcttacgtacatttcagtggtttgtactgattcatgaccaagaaaatcacggatataatatatatttatatcacattccaatagatgtgtagcttttgatcttctcaaaatatgtggagttatagttccttgaaaaaaatctttattttcttttcgacattcattagtatatttattaattatatatgtaattcctggtcttgtaagtttttttaaacgtgaattcataaacagataatcattattctgcaaatcgaaagctctaatgtactttaagataattgagtttacatttgatgatataggtatttctctttgttttctacctttacctaacagtgagatagtatttcgtttaaaatcaatatcctttacctttatttctataaattcactaacgcgacaaccactatcatatagtaaacttattaaagccacatctcttatacctttttttgtggtcgtatcaggttttgatagtaaaagttttatatctttcatttctatatatctcttttgtttttttatttcttttttaaatttaattttcaaaatatcagtacattgatccagatattcaatattttgatttataatatagtcacataatgtatgaataactgctaaacgtaaatttcttgttctgatagaattttttttataatcttcaagccaattaagatatttgatgacaatttctttttttaagtgacataaagttatatttttttctaggataccaatactttttaaatattcaataaaagtctgtaacgagtatgcatatgtttcgattgtattttcactgacacctctttgctttcttaaataatcagtaaaaaatctactgataagttctgaaaatctactatgtttcattttctttcacctttggaaacaattcatttattacagatatatgagacatatcattaaatttataatatggaagatgaatatagacttctgtttcggtaattttctcatgtccaagtaaacaagataataaataaatatcttggttgacatttataccattactgatcattttttcaatcatatgtactgctgcagtatgtcttaatgtatgcaaactcattttcttattggtaagattttcattatatccaattttttttatgatttttttataatgataataaacaacttctttggtcaaaggcttagaattatcaagttgaaaatataatttattcacaaaaaatacttcattttgatatttttctaagcatttgcacatactttcacttagagggacatagcgacatttattattttttgcatctttaataaatatatatttttttgtaagatttatattttctcttttcaaattcaaagtttcagatatgcgtaatccacaagaacaaagtaatcttataatcaatggcattgttttcttgatatatggtttcaaattttggttattttgacaataattatcgactgctctgattacattataaatttcttcattatcaaaaatatatggattaaactgccgtttccttgcaggtaacgatttctttggtataacatatgcttttttacccatttttacgagatataacccaaattgtcttagtagactggcataggtatatttttgatttgcttctttttttgaaatgatatattctacacattttttcgaaagaactgtatcatctgataattgatgtaattcttgaaactctaaaatcatacaatcaatatgcttcaactgatataatattgctccactatatgaatatcccaaagatcttttataggtaataaattttcgaagttcataatttgatatattatttaactttatttcattcataaaccggcacctccaaagctaaaaacctcaaagtttcaacactaattttagaataagcttttgtactttcagatgtagcatgtcctaatatattagctattgttgtgtttgttttcccattattaattagctgatgtgccaacgagtgtcttagtacatgtgagtaagactttctattttttaaattaattccagattctaggaatgcttcatgaactattgctgtaattctcatttttgaaagctttccttttaatccgttttttggtaaatgagtaaataaatatggtgacgatgtatctgttcgtatttttaaatagtctagtattgcatgttttaattcataaggaatataaagtttgacttctctatatgttttgctttgtacaaatattacacagttgtcattccaatggatatctttaatttttaataaagaaatatcaactgctcttataccgagtaatgagcataaaagtactatcgcatattttcgttttcctgcttcatgatctctattgatagaattgataatacaactgatttcactgtctgtataaaaatcaggaagttgtgtgtttttataggatttaattccataaagcaataacgaataattttgatcgatccaattttcatcataagcatattttaatataagtctcaatttacaaatgagatcatgaacagaaactggtttaagaaatttttttgtaaattcaagataactgattatgatattttgtgtaatcttatccaaagaaaaaatattattaaaatatagataaagaagaaaacgtaaaagataagatttaatagtgctgacagcatttatactatgtgattgttcccaatttttcaaaaattgaaaggaaaaatcaataagattgtttgcttgattattaaattgattatgcatatccaattcatagaagtcatcaataatagaaataactcgcagatatttactccttacatcaaattttccattaaaataaagggactttataaataaaaatagagaatttgaagtgatgtagttaaggttcatgttttcatggaaatttaatatagcttttaatacaatgcaataatttgaaaagcgtggatttcgaatttttaaatgtttcagataagaactaatttctggaaaaacatgtagtaataaaacagactttgataatttatcatgcataaatatgcacctccttcaaagtctaattaccataaatattatggaaagtaaataatgaggaatatattaatatatcaatatatattctggttactttccataataatttactttctataaattagattatggaaatctttccataatttaataggaatttcgattcgtttaggtataaaataaaaatatccaatcataagggtacatttattggctggatatttttatgtggctaaaaaagtgttagaaatatcattttttcctaaccattcttccattgcattttggacactgacagctgtatccttgattctctttacctgaatatatttcttcacctaaaaactcttctagtatccattccggtacttcttcttcataaccacatctcttacatttcatcggtatcattacctctggttcccctaataattctgctagttcttcatcggtcagattgatcacttgtttaccttcttcctatgctcatagctgtattttgctttgagaatctttcggtcacgatattctctgtcatttttatcgtttccaccaaatggttcatagctttctttatattccattgtttctccacattcacaaagcaatggatcccgttgaaatgattttatcatattatatctgaaatgtaactctttttgtctcttttctatcatcacccttctgtcattttttagttcttctactcttttttgtttatggctcaacagttcagccatcctgttataggtctttattgatttatttgaataaaaaccaaaatatcttaccatcttgaagttcttttcaggacagtgcatcaataccttgttaagaaaactgtaaacagattctgtgacatctacacgcttattatcttcatgacgatgatagaaccaatgaatcattttcttatcatcatcatagtttactatcctgctttcagccattattggtctgctggtataacgggttatatattgaacacatttttcaatgtcgtccttagtctgttcatctttgatttttggagcatagacatagaacccttcctcgtattttcggtagaaccagcttttaaggctttgaaattctttgtcgttgccaatgtgtctgtcaagatagctgagtaattgataacgccatgtctggcgaagttttttatagtccatataactgaagtttttgattttgtcatctttagaatcataagcatcttcgcataccagaacatggatatgcggattccagtcaagaggtctgccaaaagtgtgcaatgaggcaatggcaccaaagatcacattatcagttgtatctttgtaaagatattgagatttattgctttttttatgatagaagatacctttctttttttcaagacgcttttgtctgcgatattttctgtcgttgaaaagggaagccagagtatttctggcaacgacaaaaagaccatcaagcagtgatcggtttttgataaagtagaagcgaagctgagcagggatggtaaagacgatatgacgatgtttggatttaaaagccatagagctgacataagcagcgcgtctttgactggatttagaaccacatttggtacagtatctggaactgcaggtatgagcaacaatagtttcattgccgcagttaggacagacaaagagatcataaccaagatggatagaagaacaaaggatagttttttgaacattatcaaaagaaacatccctgagtttgcctttatcatgtagattaatgatatagtcgtaattgtcaaagaagatatatttaaaagtatttttaccgtcttttttaacaaactgcttaaaattaaaaagacctaatgtatcagaaggaacagataaatcgatcataaagtcatctcctaaaatcattataataccaaaaaggatgaaaggcatttaaaatgcactatcacccaggtggacaaaatttattttgtcccttttttatgtcccgtttttaatttctcctcattcataacaaaaaaatatccaaatatttatttacttggatactttcaggtatttttgacgcacttaaaaagaactagctttctttttttttttaaatttctagcttattgattttttttcttcgtattctttgtttttttgtttatatctgtgatatttcctcagattatgtcctattccgactaacagtatctcttcttttacaccattttctcccctccgtcgtaatcttccatatccctgatttgtttttatatcaccaaatgttccttctgtttcactgcttctcttatttattagtttttttccttcttcgctttccagattctctctgacctctttttgatattcctctaactggtagttatgattaattgttcgtcctgattttgattttgtacatctgcttcttagtggacacccttcacagtttttatttctaaacagaaaatttaatttctcataatcacttcgttcatcaattgtgactttttctaattcaaattcatgtcctgccggacatatgaatcctccttcttctgtccttttcatatggttttttttaaatctgtttttatcatttgttttttctttctctttgtaatatccactatatttcatatacaactcgatattatgttctttacagtatgcataattttcataacttccgtatcctgcatcagccggtgttttcttaggataacatccatatgcttcatgatatttttccataaatggtatatatgtatttatatcattaccgtcactgctgatataaatatttctaattattccatcgctcacgcctatttggatattatatcccggtttaaatacatttgtatgattataataatcatatttcatatgcataaaggttgcatcaggatctgtcttagaaaaactgttcctttctcccagaatgtccatatgaattgtatattcaaacatcttcatcgcgtgttcttttaattcatcatataatttttgaatatcacttcttcttttgcccctgccatgtacaaaatcaatatcttcatctttcatgtattcttctatcctatcactgatattcaataaataatcgatacttggctcttttagtaatgaatatcttagattgatattatttttcttaaaatatctattgattctgtcaatacactgattagtctttttccagcgtttagttctgtttctgatcgtattagcacgccaaacaaaagtatttttattagcattggcttcatatttagtcccgtcgatacataggacatcagtattgatattcatcttttttacaatatacctgttgatttcataaaaaatatcatcgatagacatctttaaatcatcattgatgaatctttggaaagccatatggctgggacactgattcttagcgataaacatatatctaatatcagttttacaaagacgttcaaggcgtctggtagaagcatagccgtattcagctttagcaagcagaactaaaacgaacatcataaaggaatcataaccatgggtatttctgtgagagaagtcgacatacttatttatatttacctcccgagcgacttctaaaacagttctacaaatatcatcatggggaacatctttttcaaaagaaaaagaaaaatccagtagcaaataagattgaaatgagttataatttgaagtgttaatattaatatttgacatgaaaatattataccaaaaaaacgctcgcttgagcgctttttttgttttatgaagctgtaaaataattatttactcgttacagcccctttatgttggacatttgaaagctggatgatacaattattttaggggaagtgattttatgaaatgtgataactgtggtaatgaaataaaaaatatgctggtttgcccgctgtgtggatatcgtcagggaaagataaatcgctgcagtgtttgtacaacaatagttcattatggtcaaagtaattgtcctaattgtgggaatccaactaaatatttaaaaaaagaagacattaataaaaaatattatcttaaagatgatctagattattcaaaacatacagcaacgactcatgtttatcaaagtcaggagatgtatgattatcaagaaagtgataatgatataaagaaacgctttgaagaagcgagagataaattaactagaaatcacaaaaaaacagttaaacgggatcgagaaaaaaagaatttaattgcaatagtcttaggaataatatttttatggggagcactttttaatttgtttgttagtgatgaagctaatgttgaaatggttgatataaaagaaatgagtattaatggtgataataatgatttgatgatggcaggtaattttcagcagggaagtgtagtgtttttagataatgatgaactttatttaggttgtgattatgatctaaagaaggcggaccgatcttttgaaaaaatagaaaatattgattttatctcagatagtttgagtggaaatatttatattgaagataattacatttactatgataattttggtatatataaacgttacgatataaatagtgggaatattgaggaattattttatgatgaaaatattttaccaataaaaaatcatcgttttttgtataccaatgaaatgaagttatatttatatgaaaatggtgaaagccggttaatagacagccatgatatttattatttagcatttgattttaaaacagaacttatttattttgaagtagatggagctattagggcaatcgatttagagggacgattcaaaaatgaatatgatctttatgcaataggtaatttttatgttgatgatggagttatctattatagtaatattaatggtatcgaagcctatgatacgaaaatagatgattctataagttatcttgatgaaagtgatatttataattttattgttacaaataatggaattgtatatactgatatggaaaatgatttatactatcataattttgatgatgaggaaatatatttaattgatagtgatatttatgaatttaatgtagctggtgacaagataatttacagaagtaatgatgatgaatataactggtatataagtgatgggtatagtatgagtaagctttttgaatagacttgatctaaacaattaagtctacttttttttgatctagtaatatggtaaaataaaaacattaaaaagcaggtgatgaaatggaagaaaataaaagatgtaaaaaatgtggagctcctttattggcggatgaggatcgttgtccaatatgtgatacagtacaaaataatgatcatgaccaaataactgaaaagaaaaattattggaaaaatccaattatatggacattttttgttgtgttattgattattagtgttgcaatcaatgggtatttgaatgttaatccaatcgaattagcggatcagaaagatgttgatgaacaggcatatgaagatgctgttttaacgattgatgaggaaacaagtcaatatgctcaagctactaataataatggactggcagtaagttatgttaataaggataaggtttatattgtaatgaatcaagaattgattgcttatgataaacagttgaataatcgcgaacatgtatatgattttgctttaacagattttaaagatgatggtaaatattattattatcttgatgaaaataatgattattatcgagttgataaagaaagtaaaagtgaggatgttttattaactaatgtttattatgttcaaaatttaggtgaaaaaatatattatcaaaaagatagcgataatgaatctatttattgccttgatttatcaactaatgaagataaaaaaataaatgatgaagtttcatatagcttgatcattgatgaacaaagagaacggattttttatgtgaatgaaaattcagaattaatctcaattaaatttgatggtagtgatcgtagagctctagcaagtaatactaacacatatacttatgatggggagtatttatattatataaatgataaaggtttaattaaatgtgatttagatggaaatcatagtgatgtttatgaaaataataatttgcagctagttaatatcgttgatgatcatttagttgttcatgatggtaatgtgatttatacgatgacgcttgaaggtaagaaggtaaaaaaactttatacgatcgaaagcattggaaaattgacatttgaggtagtaggcgataaacttctagttttaacatcaatttaccaagagggaaatattggttatgaagtagttggattagatggcaagagacagatattagaaagtgatataccagaaatagctggtgaagagatttagggtgaaaaaatgaatgtaagggaaataattaatgccacaaatggaattttattaagtggtgatgaaaatttagaaattataggatttagtcaagacagtcgcaaaattaaagctgggatgatgtatatcccattaattggcgagcgctttgatgggcatgattttattgaaagcgcgtttgcaaatggcgctagtgcaataattagtgatcgtgatattaaatctgatgataaagtagtcatcaaggttgaagatacattaaaggctttgcaggatatggcgcgatatttaagaaagaatcgtaatgtcaaggtcgttggtgttactggcagtgttggtaaaacaagtactagagatatggtttatagcgttgttaaaaagggatataaaactttaaaaacagaggggaattacaataataatattggattgccattgacgattttaagacataaagatgaagaagtgctagttttggaaatgggtatgaatcatttaaaagaaatggaagaattgtcattgattgctttaccggatattagtgcgattactaatattggtacggcacatattggagaacttggcagtcgtgaaaatattttaaaagctaaattagaaataactgtgggaatgaaagatggtagttctctaattattaataatgataatgatctgctttcaacagtcgaattagataatttggaacttgttaaagtgggaattgatagtgacagtgattttagggcgcaaaatgttgttttaaaagatgatcatagtacttttgaattaaattatttaaatgaaatatataaagtaaatgttccggtaccaggtaatcattttgttttaaatgctttaatagctattgcaatcggaattaaattagatataagtatagaaaagtgtattcagggaatcaatgaatttcaattaacaaagaaaagaatggatattattgagttaaaaaataacattactttgattgatggaacatataatgctagtgaagattccatgaaatcaagtttagatgttttagcgacttattcaagaagaaagattgctgttttagcggatatgctggaacttggtgagtttagtgaacagcttcatcgtagtgttggtaaacatgtggctattaaaaatatcgatctacttgtagtagtaggtaaagaggcacggtttattgcagctggggcaaaagatgcaggaatgatgaatatttattgttgtaaagataatgaggaagtgataaattatttaagaaataatttatgtagtaatgatgtggttttattaaagggatcaaatggaatgaaacttaaagatgtcgttacgcaaatagaggagaaattatcgtgaaaaagaaattgttggttttatgtggtggacaatctagtgaacatatagtatctagaatgtcatgtacatcagttttaaataatcttgataaagaaaaatatgatcttacactagtaggtatcgatttagatggaaactggtattatttaaatgctgatcagcaggatttagcgaaagataactggttagagaatagtcagctggttgatgatatctatggtttattacgaaaacaagatgtagcttttcccgtattgcatggattatatggggaagatggaacgattcagggattatttgaactagcaaaagtagcatatgttggctgccgagtatttagctctagtgttgcaatggataaaatatatactaaaaaaattctggatacagtagggattcctcaagttaaatcaatttatataaaaaaacgttatgacaataaattagtagtagtagataataactttgatgaaattgatgatgttgaaaattatattgttaaagaactaggaatgccttgttttattaaagctagccgttctggttcaagtgttggatgctatcgttgcgatagtcaagaggaattaatggatcgattgaatgaagcggcaaaatatgatcgtcacattgtagtagaagagtgtgttgattgtatcgagttagaaacagcagttttaggaaatgatgatgtgatcgtttctcgagtaggtcaaattatgccccatggtgagttttatacttttgaatcaaaatatgaggatgaagaaagtaagacttgtattccggctctagtcgatcaaagtattcaagaacaaattcgagcatatgcaatcaaagcgtttaaagcaattgatggtcatggattaagtcgcgttgatttctttttggataagaaaacaaataaaatttatttaaatgaaattaatacgatgcctggttttaccaaaatatcgatgtatcctcagttaatggatgattttggtattagttatagtgaattgttggatcgtttaattgaactagcagttcaaaaataaaaatatagacctaaatttggtctatatttttatttgatataattaatattaaattgttgatcaattatattgttaaaactattaataataaaatttttgttcaatccttttgaataacgatcatgacttgtttctagttcttcattatagagatttaaaggaacaagtttaaaattttcaaagttttgatcatagtaattaatgattggtgtataagtaactttttttattgaagttttatgctcttttttttcaaactctgtttgcaagatcatagaaatgttatatgcattggcaaattcatttgtagctcgggtaacttgattatctgctgagataaaagagcctaatgagtatgcaacaagggttttatgatcgttgttttccaaccattcgattggctggatacaatgcgagtgatgaccaataattatatcaacacccaactcatttaaataattagccagttctttttgttcatcgttgacagtgtaagtaaattcattgccccaatgcatactaacgattactacatcactaatttgtttagcttgttcaacttcatttttaataatatctttatgttcatcatctagtttcatcgtatcaagattacgataataaccaattaaattttgattttgataatctagtttattagttttataagtgtaaccaagaaaactgaatgtaatattgttaatttttttggttttgattttttgtcgatcttcaacagatgaatatactccagtagttaaaatattatgtttattaaaaaaattgattgtattattgcgtccttcaattccggcatcgttagcatgattgttggcaagattaagggcatcaacacccatatcaataacttcttgaccaatttgtataggtgcattaaaactataacctttgccagaaatacctaattcacttcctccgattggcacctccatattagcgagagttagatcatcatttaaaaagtaaggttttactaaatcataataacctttattttcataatcggaaccaagccagtcataataaggctgttcatataataagtctccaataaaggatgctataactgtagttgttgatttggctggaattttatcagatgtttttttgtttgtagaataataattccagctagtattaataattgtaaataaaataataaataaaattattttaaagggccatttcaatctacgcatttttatcaccactatatattttaacatataagggtaaaacgtatacttaattatttttataaaaactaaatgatttcttaagataaattagctattttagtatttttaatttagtaaaatgttatcgaggagttgaaattatgaatgatgaagttgaattagaaattacgtgtattcactgtttggaaaaaggaacgaagaaactgttcccgattattaaaagtgataatttgagggcaaaggaattaatatttaatgatgaactatttttatatcgttgcagtcattgtggtcattatcaaaaaatagtatatgagtgtgtatattatgatgataaattaaaatatgcagttattttatctcatgatggatcaaaaaaaatatcaaaaatggaggtaaataaatatcaaataagatttgtcaaagaactaaatgaacttaaagaaaaaattattataaaagaacataatttggatgatcgaattgtcgaaattatgaaaaataagataagaagtacaataacgagtaaggcaacgtatcgtttgtttttggttaatgatcataatgaattagtttttatgctggtttatccaaataatgaaattattaaaacctatacatttgattatacaatgtattttgatttaaaaaataaatatgaaaagagtttattagatgattatattgttgatgctaagtacgcgtctaaaattattttgaattctgatgatataattagagataagcaaataaacgctgatatttccaaggttttttaggttgatatttttgtgtaataattaattatcgaagtaataattaattgtctttaaaatttatgaaaaaaggttgacttcgacaaaatatcgggctatcatattcagtaacataacttaaatactttgataggaactagtagataaatttttcaagcatagagaagttctggctggtggaaagagctgttgagggtttattgaactcatccttgagtggagcgctgaatcaagtaggtggctacggaatgcaaccgttatctagcaagagtatgaactaactatataatagcgtacttagtgaggttaatatcgtgaggtattaataaattgaggtggaaccacggggttactataccttcgtcctcaaagtgacaggagtcattttgagtgcgagggtttttttataagtatttaaaataatgaggaggaaaaataaaatgatgaattatcaaaagtataagagatttgaaccaatcagctttaaagaacgtacttggcctgataaacaaattgaaaaagcgccaacatgggtttctgttgatttacgtgatggtaatcaagctttgatcacgccgatgaaaatagaagaaaaagtagaaatgtttcaactcttagttgatatgggatttaaagaaatagaagttggttttccttcttctagtcaaatagaatatgattttttaagaattttaattgatgaaaatttaattcctgatgatgtcacagtacaagtcttgactcaggcaagggaacatttgattagaaagacatttgaatcgttaaaaggattaaaaagagcaatcgtacatgtttataattctacttcagtattacaaagagatgtggtatttaataaggggaaagaagaaattaaacaaattgcgattgatggtgttaaattagttaaagatttaagtaaagaatttgatggagaagtgattcttgaatattcaccagaaagctttacaggaacagaattagactatgctttagaagtgtgtgaagctgtaatggatgaatggggagcatcaaaagataagaaagtgattattaatttgccatcgacagtagaaatgtcaacgccaaatgtttatgctgaccaaattgaatggatgtcaacacattttaaagatcgtgaacgagtaatactttcattacacacgcataatgatcgtggctgtggtgtcgcagcaacagaacttggtattatggctggtgctgatcgtgttgaaggaactatttttggaaatggtgaaagaactggaaatgttgatattgtcaatgttgctttaaatatgtttactcaaggagttgatccaaaacttgaggtaagtaatattaataatataaaacatgtatatgaaaaagttactaagatggaagttccaccacgtcatccgtatgttggaaagttagtttttacggctttttctggtagtcatcaagatgcaatcaataaaggaatgcatgcgatgcaggaaagaaatgatggtatttgggaagtgccttatttacctattgatccaagtgatgttggtcgccaatatgaaccaattgtgcgaattaattcacaatcaggtaaaggtggcgttgcttatgtgatggaaagtatgtacgggttccatttaccaaaaggattacaagtggattttgcaaaaataattcaagatataagtgaagaagaaggagaagtttctccagaaagagtttatgatacatttattgaagagtatgtagataacgaagaaccttatcgctttattaaacaaaagctggttgatataagtgaagatgaaactgaatatgaaagacgggcagaaattacgattgaagcacatggtgaagttgtaactttaacgggttatggaaatgggccaattgatgctgtgaaaaacgccttgaattcacttccagaattacattcgcatttattggattatagtgagcatgctttaacttcaggatcaagttcaaaagcggcagcttatgtttatttaagggctaagggaagtgcttgtcaagaatatggtgtagggattcatccaaatattacaacggcaacaataaaagcaattgtatcaggaatgaatcgcttaactaaggcaatgaaataagaagaagggagccaataacatgaatcgtttagtattatcgttattagtggaaaataatcctggtgttttaagtcgtgttgccagcttatttagtcgtcgtggttatggaattgacagcttgagtgttggaagaactaatcttccaaatgtttcaaggatgactatcgtagcggttggtgatgaattgattttaaatcaaattgaaaaacaattaggaaaattagttgaagttattgagatttttccattagaacctgataaatcagtttatcgggaattggttttaattaaagtcgaggcagatgaaaagcaacgttcttcaattgtttcgattgcggatatttttagagcacgaattattgatgttgcaccagcatcattagtcatcgaagcaacaggagatcaatcaaaaattgatgcgttgcttgcgatgttggaagggttcaatgttgtcgagctcgttagaaccggattatcgggaattaaacgcgggcttggtgaaattgatataaaaagtcatagtaataagtaaatagggggttaagaaaaatggctaaaattttttatgaatcagattgtgacttatctttattagacggtaaaacagttgccgtaattgggtatgggtctcaaggacatgctcatgcattaaatttaaaagaatctggagtacatgtaatcgttggattatatgaaggttctaaatcatggaaaaaagctgaagaacaaggattagaagtgtatacttctgctgaagcagctaaaaaagctgatatcatcatgatcttaattaatgatgaattacaagctaagttatataaagaatcaattgaaccaaatcttgaagaaggaaacatgttgatgtttgctcatggtttcaatattcactttaatcaaatcgtaccaccaaaaaatgttgatgttacaatgattgcaccaaaagcaccaggacatacagtacgtagtgagtacttagctggaaaaggaacaccatgtttagttgcagttgaacaagatgcttcaggacgtgctcaagatattgctttagcttatggtctagcaatcggtggagcaagagctggtttattggaaactacatttagaacagaaacagaaactgatttatttggtgaacaagctgtattgtgtggtggggtttgtgcattgatgcaagctggttttgaaacattagtagaagcaggatatgatccaagaaacgcatattttgaatgtatccatgaaatgaaactaatcgtagatttaatttatcaatcaggatttgaaggaatgagatattctatttcaaatacagctgagtatggtgattatattacaggaccaaaaatcatcactgcagatactaaaaaagcaatgaaacaaatcttagcagatattcaagatggtacatttgctaaagacttcttattagatatgtctgcagctggtggacaagctcactttaaagcaatgagaaaattagcagctgaacatgaatctgaaaaagttggtaaagatattcgtaaattatacagctggtctgatgaagacaaattaattaataattaatcaacacacacttttgtgtgttgtaactagggagtaagctactccctaattacaacctacaaaggtcaagataagggggattataatcatggcaatgactatgacacaaaaaattttagcaaaacatgcaggtttagatgaagttgtagctggacaattaattgaggcaaaacttgatgttgtaatggctaatgatattactggaccaatggcgttaccaattttttatcaaatggcagataaggtttttgataaagataaagttgtattagtgccagatcattttacgccaaataaagatattaaatcagcagaaaattctaaagcaattttagatttttctaataaacaatgtttaactcatcatatggaacaaggtaaatgtggtgttgaacatgcgattttaccagaaaaagggatcgttgtagctggagaatgtatcattggagcagattctcatacatgtacatatggtgctttaggagctttttctactggagtcggtactactgatatcgcaacaggaatggcaactggagaactttggttcaaagtccctagtgcaattaaatttgttttaactggaaaaccatcacaatatataagtggaaaagatattattttacatatcattacgaaaattggagttgacggggctcgttataagagtatggaattcgtaggcgaaggaattcaatatttaactatggatgatcgttttacgatttgtaatatggcaattgaagctggagctaaaaatggaatttttccagttgatgctttaacaattgattatatgaaaaaacattctactaaagagtatacgatttatgaagctgatgaagatgctgattatgatgaagtaatcgaaataaatttaagtgaagtaagaccaactgtagcattcccacatcttccaggaaatggtcatacgattgatgaaattgaagcaatggataaaattatgatcgatcaagtagtaattggttcttgtactaatggtcgtttatctgatttacgtaaagcagcagcaattcttaaaggaaaaaaagttgctaaaaacgttcgcgtaatggtcgttccagcaacacaaaaaatctttattcaatgcatccaggaaggtttagcagagatttttgttgaagccggatgtgcttttaatacaccaagctgtggtccttgtatgggtggtcatatgggtgtaatggctaaaggtgaaaaatgtgtttcaacgactaatcgtaattttgttggtcgtatgggtgatacagaagcattgatttatttagcttctccagaagtagcagcagctagcgctattgctggatatatcgcaaatcctgaaaaagtaggtgaagagtaatgaaaatatataaatatggtgataacgtagatacagatgtaattatccctgctcgttatttaaattcatttgatgctaaagagttagctagtcatgcaatggtggatattgatcctgattttgctaaaacagttgaagatggtgatattattgttgcgggaaagaactttggatgtggttcttctcgagaacatgccccattatgtttgaagacagcaggaactaaatgtgtaattgcggaaagttttgcacgtatcttttatcgtaattcaatcaatattggctttccaatcatggaatgtcctgaagcagtagcgggtattgatcaaggtgatgaagtaactgttgatttttcaacgggtttaatcactaatgttacaaaagggcaaacttatcaaagtcagccatttccagaattcttacaaaaaatgattgaagttgatggcttagtcaattacgtaaatagtaaaaaggggtaagagtcatggaaaaaaatattgcagtaattaaaggtgatggaattggaccagaaatcgttggtgaagcgatgaaggttttagatgctgttgctaataaatataatcataaatttaactatacgcaaattttaatgggtggggcatcaattgatgtacatggtgtccccttaactgatgaagcattagaagttgccaaaaatagtgatagtgttttattaggatcaattggtggcgacacaacaacttcaccctggtataaattagaacctagtcttcgccctgaagccggattattaaaaattcgtaaagagctagggttatttgcaaatttaagaccagctgttttatatgatgaattaaaaggagcatgtccattaaaagaagaattaactgaaggtgggtttgacatgatgatcatgcgtgaacttactggcggtttatattttggaaagcgttcaactaaagaagaaaatggtgaattagttgctcgtgatgcgatgagttatagtgaaacagaaattagaagaattgctaagcgagcatttgatattgcgatgaaacgtaataaaaaagttactagtgttgataaagcaaatgttattgatacttcaagattatggcgcaaagttgtaagtgaagtagctaatgactatcctgaagtaactttagaacatatgttagtagataactgtgcaatgcagttagttaaagatcctaaacaatttgatgttattttaacagaaaatatgtttggtgatattttaagtgatgaagcaagtatggtgacaggatcgattggaatgttatcaagtgcttctttaagagaagataaatttggaatgtatgaaccaagtcatggtagtgctccagatattgctggtaaaaatattgctaatccgattgcgacgattttatcggcggcaatgatgcttcgctattcatttgatttagatcaagaagctaaagatatagaaggagcaattgaaaaagtcttaaaacaaggatatcggactgctgatatcatgtcagaaaataaaacaaaagtaggaactaaagaaatgggtgacttaatagttgctaatctataaagataaagggggaaataagatgcgtagtgataatgtaaaaagcggaactgaaagagcgccacatcgatcattatttaatgccttaggatatactgatgaagaattagaacgaccattgataggggttgtaaattcatataatgaaattgttccaggacatatgaatcttgataaaattgcagatgctgtaaaaaaagggatttatttagctggtggggtgccaattgaggtaccggctattgctgtatgtgatggaattgcgatgaatcacacaggaatgaaatattcattagttacccgagaattaattgctgatagtacagaagcactagcaacagcacatcaatttgatggtttagttatgattcctaattgtgataaaaacgtacctggtctattaatggcagcagctcgtttaaatattccaactgtttttgtatcaggaggaccaatgttagcagggcgtaaagtagatgggaataaaacatgcctatcttcattgtttgaagctgttggtcagtttaatgctggtatgataactgaagaaaaacttcatgaaattgagcaaaaagcttgtccgacttgtggatcatgttcaggaatgtatactgctaattcaatgaactgcttaactgaagttttaggaatgggtcttaagggaaatggtacgattcccgctgtatatagtgaaagaattagattggctaagcatgccggaatgcagatcatggaatgtattaaaaagaatattagaccacgtgatattatgaatgaaaaagcttttcataatgcattaactattgatatggcattaggatgttcaactaactcaatgcttcatttaccagctatagctcatgaagctggggttgaattaaatttagaaattgctaatgaaattagtaaaaaaacaccgaacttatgtcatttagctccagctggagatacatttatggaagatttaaatgatgctggtggtgtctatgcggtaatgaatgaaattaataaacttggtttattatatactgatattatgacggtaactggtaaaacagttggtgaaaatattaaaggatgtgtaaacttgaatcctgaaattattcgtccagttgaaaaaccatatgcgccatttggaggaattgcggtcttaaaaggtaatttagcacctaatggagctgtagtaaagcaatcagcagtagctcaggaaatgatggttcatagtggaccagcccgtgtttttgatagtgaagacgaagctatcgcggcaattagagctggtaagatcgttaagggtgatgttgttgtaattcgttatgaaggtccaaaagggggaccaggaatgcgtgagatgttatcacctacaagtgaaattgcgggaatgggattggataaagatgttgctttgattactgatggtcgtttttctggagctactagaggagcttcgattggacatgtttctccagaggcagcttcagggggaccgattgcattagttgaagaaggcgatattatcaatattaatattttagagcattcaatgaatgttgaagtaagtgatgaagaattggctaaacgtaaagctaaatggcagccaagaaaaccaagaattacaacggggtatctagtaagatatgcgtcaatggtaacttctgctgatcgtggagcaattcttgaagctaaagaagaaaaataaataataaggagggaattgctatgaagttaacaggttcggaaattgttgcagaatgtttgatcgaacagggtgtagatactgtatttggttatccagggggaacgattttaaatatttatgatgcattatacagatatcaagataagattcatcatattttaacatctcatgaacaaggggctgcacatgcggctgatggatatgctagagcaacaggaaaagttggagtatgtatggcaacatcaggacccggggcgactaatttagttacagggattgctacagcatatatggattcaactcctcttgtggcaattactgctaacgtagctgtatcactattagggcgtgatagtttccaggaaatcgatattgctggggtgacaatgccaattactaaacataattttattgttaaagatattaatgaattagctccaacaattcgtaaagcttttcaaattgctaaagaaggacgtccaggaccagtattagttgatattactaaagatgttacagcagctacaattgactttgcgccatgtgtaccggatgtaattgaaccacgtcgatatacatatggatcacaagagatagatcaggcaataaaaatgatagaagctagtgaaaagccgtttatctttgttggtggtggggctattgctagtgatgcatctaatgaattaaaagaatttgcggaaaaaattgatgctccagttaccgattcattaatgggtaaaggtgcttatgataatactcgtcctcgttatacaggaatgattgggatgcatggtaccaaagcttctaattttggagttagtagatgtgatttattgattgttattggtgctcgtttttctgatcgcgttactggtgatactaaacgctttgctaaagatgctaaaattattcacattgatgttgatgcggctgaaattaataaaaatgtaattgttgatttaggaattgttggggatgctaagagtgtattaacggaattaaatgcaaaacttacaagacaaaatcatcctcagtggttaaaagaagttcgtgatttaaaagaacagtatcctttaaactatgatagtgaagggttaacaggaccatatgttattgaacaaatagattatttgacaaatggtgaagctatcatttgtactgatgtaggacaacatcaaatgtgggctgctcaatattatcgctataaacgtcctcgtcaattcgtttcatcaggtggagcgggaacgatgggatttggtttaggggctgctatgggcgctaaacttggtaatcctcatcaaacagttttcaatattgctggcgatggctgctttagaatgaatatgaatgaattagcaacattaagtcgttataatattccagtaattcaagtagttattaataatcgggtgttaggaatggttcgtcaatggcaaacattattctatgggcaacgttattcaaatacgatcttagctgataaagttgatttttgtaaagttgctgaaggtttaggatgcaaagcaattaaagttacaacgaaagaagaattagttcctgctattaaagaagcaatggaatatgatggaccaattgtaattgaatgtataattgataaagatgataaggtattcccaatggttgcaccaggaggaccaattgctgaagcatttgatgctactgatttaaaaaataaataatgttttaaaagctatagactatggtttatagctttttttgaccaatgaatctctaattgaaccgttgaatcaaaaagcatcataataagaaacaattgatgtataataaagataaacagaataccatcataattttccaataatagttaagtaaaatatgtaaagaaggtgaaaagatgcgaaaagtaatgataaatgtaatgttgcttattattggaataggtctatctagaatctactttcttatattcggttattttataagcaagttttatgatataggagagggaattgggattacttcattgatgctttatttatatcttattttagccatcccactaattttaattattttaaagaaaatcaaagaattattaaactaagaattataatatgaataagattatgtaaaaagatctttgtgatgacagttcctaaatacttattttaaattaaatattttttatgtatttaataagatattgtttgagaaaaaaataatatgaaaaggaaattattaggatttataacatgtatttgtttatcattgagtttatgtactgttactacaacaaatgttgaagcagaagcgcgtttatcgtttgcaaaaactgcattatggtatatttaaaaaattatcaactgctttttattttagaagtccaagtatcgaaattggagataattatatagttctatttattttaatcaagtaaatacaggaatgatgatataccaatcaaagagattattaaaatattaccaacacaatttgtacaggttaataaaaatcaaattataaatattgataaaatagcttttatgagagagatgaagataaaattaagacatagtaatgtaataatagaggttagtagaagaaaaagaagggaagtatttgaattaatgattcgagcaattaatcagatataattggctagtcgatgaaagaaactttttacttaagtttctttttttgggtgagaatttgatgttttttcatatgaataatttttaatttgtttatctgcaaaatattttacactatttgaagcaaattattatcaaactcattatctcctgtaagacatatttttacaaaaatatctgtgaatattattttaatagcataaatatttattttttaaaactataataaaaaatcttataaattaattgattaaaactttacataaacttggtattttgatttaaaggagatgattataatttatctgaaaatgaaaggagaaaaataatgatatggcaaaagaaatttcataaaattagtatttgtctactgtctttagtgatgatattttccataatgtatggaaatctaaattttattaacgctcaagaacagcgacagactattgcaaactggaatatagatagtaatcctgaaacagtaccagaaaaatctgtaattccagctacttttggagaagggtttaatttgactacaaatgccacaggaacctggggaaatagtgcaagctattttttagcagctagtggctttgatggtgaagcgggcagtaaatactggcaaattgaaataccagattcaagttatgaagatttacagattagttttagcatgcggcgttcaaaaacgatgaatcaagagtggcatgttttatattcacaagatggtttggaatacaaaaaagttagtgaaagtgattttgagattactgctacctctggagctttaaatgcaatatcatggaatgataatacatatttaagtatacctagcgaggctagatatattcggattgttccaagtgatgatgttagtagtagtggagctacttgctatttgaataatattacattaacggcattgttgggtaataaagtaagcaatgtaattattgctccaaatggtggccaggtagcgttaaagacaaaattatcaatgagttgtgctacgcctttagcaacgatctactatcagattggaaatgacgaggctagggtttatgatctaaataacccaccagtgttaaacgagctgccttgtacgatcaaagtttgggcaactttagatggtaaagaagacagtgatgtaaaggtatatcaatttacagaaaaatacagtacgataaatgatgctcgtaatggtgaaaataatgaatttacagttaaaggcattgctacaagtaaatatgataatgcatcattaggtcaatatattcaagattctacaggcggaatcatgttatatggggatgcagttttaaaagataaaaagattcaaattggtgatgaagtaatcgctaaaggagttactaagtattatagtggtaaatgtgaattagaagtaacggatgttcaaatcataagcaataaaaacgaagttttagctacaactgtaacactggataaaattggtgatatgtgtggtggaaaatatgtagctttagatgaagttattgtaaatagtatgtctaaagacaattataacaatgctaatctaactttatttaaggatggttatacactaaatgccaaattagattcacgtcgtggtgatgattatgagatcttagcaaaaaagattgctcaaaacaatgttatcaatataaaaggaattttagagggatataatggctcatatattttacaattattgaatgctaatgatgtaactaaagtggcagataagccaagtgaagagattgccggtgttgtggctagtcaaggtagtggggagttggaattgaatagtaaaatcacattatcctgcgctacttcagatgctaagatcatgtataagttaaatgatggtgagtatcttgaatataaagagcctattacgatcacagttttaccagcaacattaaaaacttatgctattttaaatggtgaatcaagtaaggaaataacgtatacataccatgaagtatttacaggaatatataatacttattttggtcaattacacgctcacacaaatttatctgatggggcaggatcagttgaaagtgcttttgaatatgcttcaaaagttaaaaatttagattttttagcagttactgatcattctaactcatttgaaggtagtaattatgaagcttcgatcaatgattcagcaaataatgaaaaatgggcaactggtaaagccgcagcccaaaatatcactgatcaaaaaattattaatgacgatgttactagcgctggatcaacttttttaggagtctatggttatgagatgacatggagtgatggtagcggacatattaatactttcaatacagccggttttgagaatcgaaataatgcaatttttcaaaacaaaaaacagtcagcaagcaatccttcaggattagcccaatattatgatcgtttagttagtgccgcgacatcaatttctcaatttaatcacccaggaacaactttcggagatttctatgactttacaaactatagtgttgaaaacgatgcaagaattaatttgattgaagttggtaatggtgaaggagctgtaaggagcggtggttattttccatcatatgaatattatacaagagtgttagataaaggctggcatgtagcaccaacgaataaccaggataatcataaaggggcttggggtgatgcaaatacaactcgttcagttattttagcgcaaacattagatgaaaatagtttatatgatgctttaaataaacgtcgtgtttatgcaacagaagataatgatttgaacatttattatactttaaatgatcaaatcatgggtagtgaagtatatgatgctggtgaaactgttcaccttagtgctaaaattagtgatcctacagataaagcaattggaactgtagaggtaattgtaaatggaggaatcgttgctgcaagtaagacgatttctggaaatgaagggaccgtaacatttgatctgcctaataattattcatattattatttaagagtaactcagccagatcaagatatcgcagtaacggcgccagtatggacaggcgaagtggaaaaagcgggcattgctagtgttgcttgcgataccgaattacctattaaaaatgaaaatgttggaattactacaacactatataataatgaaaatgtcgatatgataattaaatcgattgaatattttgtaaatggaaatgttattcgtagtatcgatggtagtgaacttactaatggtgcgattctagaatcgttaaaaacaacgacagatgaatttacatatattccttctgtaaatggagaaacaacgatcaatgtagttttaaaggcaatgatcaatggggtagataagacttataatggtttggttaaattagatgccgctgatccaagtacagttacaaaagttgtgattgatgggacacattttaatgattatgtaaacggatattatagtgggaatatggataactttatcaagttatgtgctaatcaaggtgttcaggcaagaatagaaactaataaaattgatgctaaattattgaaagatacagatttactggtagtaacggcgccaatgaaaaaagtgacatctattagtggtgaaggaatgcagccgagtgtttttgaagaatcgtttatgaaagatgttgctgaatatgtaaataatggtggaactgtaataacatgtgcattagctgactatcaagatgcaaatgaagatccatatacatcaagtacacaaattaatacgttattaaaaacaattgggtcatcgatgtcaattaatagtgatgaagtaattgatcaagaagttaatgatggtcaaagttatcgtttaaaacttaaaggaacatataatagagattcaaaatggctagcaggggtagttgatcaacaagagtacagcgtttattcaggatgttcagtaaatcctggcaagggtgaagcactggttaaagggtttgacacaacttatagtataaattctagaaaaagtaatagtaaatatgaaagtgataaaccagtactaagtgccactgcaccatatgatgaaaatacagctgtagtaaaaaaaggtgatgtaacagtgttggcagctgaacaagttggtcaaggacaggtatttacagctgggacagtgttcttatcaaattttgaagttaaggcagacattgataatatttatgacttgcaatatataaattataatatcgtaactaatattttagatagtgtaaaagtggatgttcccacaacaagtattgcagaagttcgtcaaaatggacatcttggagatatttatgcagtagaaggaattgttactgcaggtagtgaagctccaaatgcgttctttgatacaatttacatccaagatgaaactggtggaattgatatttttccaattgctaatggcagtgggatcaaagtaggtaataaagtacgtgtaattggatatgttgatgaatatcaaggggataaagaattaaagattggtaatagtggtgtttatggttatgagataattgatgatgccgttaatccgctggatccaaccgaattaagtttaatgcaagctaatgattatgaaaattatggtggattattagctaaagttaaggggagagtaactgaagtaaatattgtcgatggtatcttagataattgttggattcaagatgatcaaggaactagatttagaatatttgttgatggctatattaatcctgaagtaaatacaagtgatgtaattcaagtaggtaacgaagttagtgcgattggaatcatatataataatccagatggtgtttgtttaagagtccgtgatcgtaatgaaattagattagaaacagtgagtagaatagacaagagtgaattacaaaagttgatcgatgagatgttaactaatgatggatatagtgattctagttatgcaagctatttaaaagcaatcgatgagggtaaaataattttagctgatttgaatgttactcaaagtgaagttgatcaggcagttgaaacaattaaacaagctatagaaaaacttgaaaaaaatcctaaaaatgaaattacaaaacctggtgatgatcaaactgctaaacctactgtaacagaaactactaataaaaataaagcagttgaaacaggagataatagtaaccaggaattagttttaataatggcaataataagtatatttggatatagtttgattagaaaaaaagaaatttaagctgataaagcgccacattgtggcgtctttatcattggaggaaaaaaattgaagttaaaaataaaaaaaattactaaaaaacaatttattaagatggcattaatattcattgtaactgttatatttgttagtgctatttatttgattaatcaaaataaccaagattatcaatcatctagtgctggtaaatatgtaaaagctattgttttagaggttaaagatgataaattagaaactagtgataaaagtggtttacagctaggaagtcaagaagttagtttaaaaataactgaaggtgagcataaaggtgaagtacatgatgttacaaatgaagttagtcaacttcataatatagttgtaaaaaaagggactaaaattattgtaacgattttagaaaatactcgtaacagttataatgtagctatttataattacgatcgtactaatacgattttgattagtataatactttttgtggctctattatgtcttattggagggataaaaggatttaaagctgtattagggttagcgtttgcgataattgggatagtactgatcttaatacctttggtagctagagggtatgatgctattttagtgtcgattggtgtggtgagtattattactctagtatgctttattgtgtttgatggagtaagtgcaaaatcgatttcggcaattattgcaacagttactggagtagcaattgcaggagtttttgcttatttagttcaagttttagggcatttgagcggttttaatatgactgaagcagaatcgttaatgttgatttctggagataatcagttttatattcggggcttattagtggcgggaattatcatttcatcactaggggcagtaatggatgtagcaatgtcgattgcttcgtcggtaaatgagatatatgtagttaattctaatttaacctttaaacagttagttgcttctggaatgaatgtaggaaaagatgcgatgggaacaatggcaaatacattgattttagcatttacaggaagttctttgaacttactattattggtcttttcttatgggataagttttactcaatttatcaataatgattcgatagccatagaattattacaaggaattgcagggtctattggtattgtaatatgtgttcctatagcagcaatcattacatcattaatttgcaagcgtgatttgaaacggaaataaaacataaagtgtttgcacatgaattgatttagaggtagaataatagcaagaggtgattgaaatgaatgcagtattaactggagatagtacgaatattacaccatatatcatattgatggtagtagcggtaatagtagtaattgggtttattgtttataagatgaaaaataaaaataaatagttgattaaagaggtttcgttaaatgaaatctttttattttgttaaaaaaagaagttgaatttcaacttcttaattatgtaataactctacagcaaatatttcgctttgagtagcgattttttttaaatcatgagctagtttttcaggtggggttttcatatttgttttgatccattgtaaaataattccagaaatgccataagtataaaattcactaaaaaatatcttttcttgatttgaaatactattatttgtatctagtttggtaatagcatcataaaaacatctttgagataagtcatagaaatcttgataaaaatatttcccattagtattaatagtattaatgtaaaaatctttttctcgataaattttttttaatactttaagcaggcattggtcccagttattaaaagtaacgatattttcaatgtctttaaataactcatcgtaatagagccattgtaaaagatcatatttatcttgaaaatgataataaaatgtttggcggtttaaattacaatttctagtaagatcatttattgaaatcttttcaaagtttcgatgctgacacaattcttttaatgatctagcaaggatgcgttttgtggttaaggaatctgacatttagttcacctctattcaattgtaacaaataattatgaataaaacatttacattgataatattattgctataataaaatcgtaaactttcgacacgatataacgaaagttgcaggagggagatatttgactaaggtaacagatttaaagacaaataacattcatcaaattagactatgtttttacaatgggaaagtaataacaaaaaatgaactagcaaaacaaacaaagctttctttagcagctacaactaatattttgaagtacttattagaacgtcaggagatatatttagctggagaagccaagtcaacggggggacgaaaatcaaaacagtatgtattaaataaagattattatcatttgttaagggtaattttaaaaaaagaagctttgggctgctgttttatggtaaatatagttgatcttttaggaaacgtgaaattagaaaaaaagattattaaaaagaaagaaatagtaaatgatattttagaaataattactagttttttaagaaaagacaacaaaatagaagttttagctttaagcattcctggagtttgtcagaatggtaaaatagatatttgtgatttcgatgagctggtaaatattgatttatttgcgttgatcaatgagcggtttgatcttgaggtgataatcgaaaacgatgttaatattgctagtatcggctttgcagatcattatcctaaaattgaaaatattgttttgatgtatcagcctaaaatcaaatatattggttgtggaatattaattgatcgtcatttgtgtaaaggagctacaaattttgctggtgaattatcatatttgccgtttatttcacactatcagcaggataggatgttggaaagtgatcctcatggtttgttattaaaacagttagcgacgatttgttgtgtaataaatccagaaattgtgggaatatgtagtgacgtttttgaaatattcgatagcagtgagctgattaaatatgtacctagaaaacattgtcctaaaattataaatattgataatttagatgaattaatatttgcaggtttatatcatttggcaatagaagtattaaaaaataaaataagaggagaaggctaatggaaaaatttattgatttgcatatgcattcaaaatatagcagtgacggtgaatttacaccagaggaattagtgaaacaatgttatcaagctggtattagaattatggctattgctgatcataatagtgttaaagcaattgatccagctaaagaaatggcagaaaaattaaatattcagtatatacctgcaattgagattgattgtacatataatggaatcgatttacatgttctaggctatggtatagattatcatcaagaagatttttttcttttagaaaaaaacgttttcgatcaagaattaaagtgttctaaagaaaaagtagagttaataaataaaatgggatttgatgtagatttaaatgcattagaaagtttaacagatagtggaatatatactggtgagatgatcggagaagtattattaaatgatcagcgttacgtagatcatccgttattgaagccgtatcgaaatggtggtgaacgcagtgataatccgtacgttaatttttattgggatttttatgcacaagggaaaccgtgttatactaaaataatttatccgagtttacaagaaacaattaatttgataaaaaagcatggcggtgttgttgttttagcgcatcctggtaataatttaaaagggcgatttgagttatttgatgaaatggtaaaactaggtgttgaaggcgtagaagcatttagtaattatcatagtttagagacggttgagtatttttataagtttggtaaaaaaaatcaccttttaattacctgcggcagtgattaccatggtaaaacaaaaccagcaattaaacttggtgaatgtcattgtatgattgatgagcatgaaattgaagaacagttaagaaaatacaaattactctaagaatacatcaaatattaactattaattttggttttgatgttatattgttctttaattaatacaatcactgtgctataatcggagcaggaaaaaggggatttgtaaaatggatttaaaaaaaagaaaatatttaattagcttcggagctgttttattatcatcgatggtcatggcatttgcgactaagaatctagtgcgcccagcaggaattttatcaggtggctttatggggattgccattatggcggatatggttgcagaactatttggtggaagtcttcctacttcgattggtttattgtgtttgaatatacctgtggcattattttgtgctaaaaaaatatcacctcgctttgtatttttttcattattgcaagttattttaacatctttatttttaccactggtaccacaaataccattatttgatgataaaattttaaatgtgatttttggcggctttttatttggtggtagtattgttattgctttgaaaggaaatgcttcaagtggtggaacggattttatttccttatatgtttctaataaaagcggtaaagaaatttggaatcaagtatttatttttaatgcattgatgcttagtgtatttggctgtatttttggttttgaagcagcaggatattcaatactatttcaatttttatcaactaaaacagtatctacatttcatactcgttataaacgggtgatgatgcagatatttacaaagcagaaagatgatgtaatggcaatatattgtgagaagtttcatcatgggattacagctatagatggaatgggaggttattctaagacaccaatatcaatgttgacagcaattgtttctagttatgaagttgatgatgtgattacagttttaaaagaagttgatcctaaaattattataaatgttagtaaatcagaaaaatatgtgggacgtttttataacgcaccattataaaattttagtagtattgtttattgatagggtgctcgattgcataaaatccaccattaaaactataagcattataaccttgcattgaaagctgtttagctaattctaaagatcttttgccactataacaaattaagtaaatgggtttgtttttagaaagtttagggggattactaataaaagaatcgtaagggatattgataaatttatgcaaatgtaatctattaaattgtaaagggtctcttaaatcgataaatgtataatcgtgtttaagtaattctggtaaattatcaatattaattaattggctatttttcatacatttcacctcattatattgtatgaaattaattgaaaacaatgaataacagtgatataattcagccatggaggaatattaaaaatggataaaaaaacaatcaaagatatcgaagtcgctggaaaagtggttttatgccgtgttgacttcaatgtaccaagaaacaaagaaactggagaaattactaatgataatcgtgtggtagcagcgttacctacaatcaattatctattagaacaaaatccaaaatgtgtagtattattctcacacttaggaaaagttaaaacagaagaagacaaagctaaaaacgatttagcagttgttgctccttgtttagaaaaacatttaggaaaacctgtaacatttgttaatgctacaagaggagcagtattagaagatgcaattaaaaatgctgctgatggtgcagtgatcttagtacaaaatactcgttatgaagctggtgaatctaaaaatgatcctgaacttggaaaatattgggcttcattaggtgatgtttttgttgaagatgcatttggttcagtacatagagcacatgcttcaactgctggtattcctgctcatttaccaagtgcagctggattcttagtagaaaaagaaatcgcatatattggaaaagctgtaaatgatcctgaaagaccaatggttgctattttaggtggagctaaagtttctgataagatcttagttattgaaaacttattaaaaattgctgataaagttatcgttggtggaggtatgtcatatacttttgctgttgctcaaggtaaaaaagttggaaattctttattagaagaagatagagttgaaattgctaaagaattaatcgctaaagcaggagataaattaattttacctgttgatgcagttgttaataatgctttctctgaagaaggagatatcaaagttgttgaaggagatattccagatggttatatgggattagatatcggacctaaatcagttgaaaatattaaagctgctttagctggtgctaaaactgtaatctggaatggcccaatgggtgtatttgaaatgcctgcatttgctaaaggaacaatttctgtatgcgaagctttagctaatttagatggtgcaaatactattatcggtggtggagatagtgctgctgctgtaatgcaacttggatatgcagataaagtttctcatatctcaactggtggaggagcttcattagaatatatggaaggtaaagttcttccaggtatcgctgcaattgatgataaataataaggggagattataatgagaaaaccaattatcgtaggaaactggaaaatgaacaaaacaatcgctgatactaaagcgtttgttgaagctgtagatgctaaagtgtctgacagtgctgattggggaattgctactccatatttagctttacaagctgctaaagaaggaactaaaaacttattagttgctgctgaaaattgtcatttcaaagatagcggagcttatactggtgaagttagtgttgaaatgttaaaagaaattggagttgaatgggtaattcttggtcactctgaaagaagacaatattttggtgaaactgatgaaacagtaaatgctaaaatgttacaagtattaaaaaatgatatgacaccaattgtttgtgttggtgaaactttagaagaatatgaagctggaacaactaaagatgttgtaaaaacacaaactgttgctgcttttaaagatgtatgtccaaaatgtgcagcgcgtagtgtaattgcttatgaacctgtatgggctattggaacaggaaaaacagctactaatgaaattgctcaagatgtttgtgcatatattcgtagtgtaattgctgatttatatggtcaagaagttgcagatcaagtaagaattcaatacggtggttctgttaaacctgaaggattaaagactttattagaacaacctgatatagatggtgctttagttggaggagcatctttacaagtagattcttatcttgcaatggttgaaaatttaggataatattaaaaggctcctgctggagccttttattttatcaattaaaggtatataaatagataatctattaataataataagggggaatttaataaagcatattagtaactattattatttatttgtgatattatatagttgcaagggaaagataaaatgaaaggaggattgaagatgaaactattgaaatgtcctatctgtggaaatgttgttgagatgattgatgatcatggggtaccactaatgtgttgtggtaaaaagatggaagtaatagaagcgggatcaatagatgctgctgttgaaaagcacgtaccagtagtgagtgttgatgatagtaagttaaaagtatcagtaggagatgtaaatcatcctatgacaccagaacattttattagtaatatttgggtagaatttgaaactggtaatattttgagggtcacactaacttcaaacgatcagccagaggctaattttgatattgctggtaaaagaggaaaagctacagtttatgaatattgtaatcttcatggattatggaaaacagaaatcgaattatagaaacctccgttgtggggtttttatttttgacttaaattgttagaagaatatgagatgaaaagtttattgaccattggatataaaatggttaaaaaatatttaaagttgtataataaaatcagatgatatggaaattataattatagttttatttgttgtaggggtgaaactaattgtatattgtattttgatattgttttaattaaaagttttatatgttgaaatataaataatggactttttaataatctaattatttcaattattattagaatttatcaatatatccattttttgtgattatcgttaataatagttaaaaaggtaaatttatttttctttttataaataactatacctgtaataactaccactgctactactatcaatactatgtatggtgtcatatttgtactatcaactgtaagtacaacattcatctaaattatttttttgcactattttagtgataaaatagtgcatataatagatttatatctaaaattattttaagaatactttcattaaattctgtttttatagaaaaataaggctatgaacctcaaaaattatttaataacgatttatcaatatactatacactaaagacaaataatgagggctatattaaatacacagtatcagataatttagatttaaaaaaattaatatattacaagttgggaattataaaacagctaaagtcaataatcatgatctctactatcaggcgacatatacaagtggaaaaatatgtgacgcattaaatgaagaattcatgctgggaattaaacagagaatattaccagctaaaaagcctcaataaaaaattttaaaataaggaatcacatgcaacattaaaaaagacaaaaagcatttaatatatcaatgttttttgtctttttttatcataaactgtcaaattcgagattttacattaaaataaaacataaaacagtgatattatatggattttggctattttgttgtgaattatttagtattttagaaatcctttaatttttctttatttggcattagcgctttctttgtttatttcgtctatttctttatcaaacgagacgcttttgatatatacagttgaattgtataatgttactttcttcatcaataaggttactgttgtcaaatgaagtttcaaaataatagctggtacagccataataagtaaatgaagtataagtatctcttggatatttgtctttggtatgttgtaatgactgtttttgaatttcatcattagtttgagtggttatggttttagtaacattagagaagtgagcaatagaatcgtcatattccagtgaaagatcatcaagatgaatgttgtattgtttaactttgctgtcctggtgataattcttatcgatgaaaagtcaagtatatccgttggtagaaatagattctttaagaaatatatagatgtattatgatacccaataatccataatagaagaaattattggtgtgataaaagtttgtcgtatcaataggattgagaatttattttggtggaaaaactcagtaaatgtaagtgattactatttacttttggcaaaattgcgaatataatttaaacagaaatagaagttattaaatagtgtgtaactggtaatgcgggcattaactatatttatttcatagaagtaattgagcttttataaatgagtattgttaatgccttttttagtagagatgcacgctttctattaaatactaactaatggatatttacaaccttcataacaggaaggagaagaagtataaaaataaaatttgttattgatcgaagaaaacagagagattgtagatcttacttatgataaaaataaattgcatagtaatgttctaaattgattttgattaatagtaaattggaattttaatcatatgtatgtgtccagccaaaaaatacggctggaaatggagggaaatgtgaaaaaatatataaatatgtatttgctacatctatatcatctgctatggcaataatgaatgtatatccagcacttgcaaaaataactgcaacagatagtattgtttctgctcgcaaagaaaaatacagagctatcaatgaatcttgcagctcaaggaatggttttattacaaaataacaacagataaagtagtaagtaaaggagatgcagctgtaagcataaaaactggagacagcaacttaattggaatgtttgaaatagttgcgttattaagtttagcaaaagcaacattattgagaaaaaaagaaaattaaaaactatatttactgataaaaacaaaatagagatgttcttcttaaaaatttaaacatatgcccgacaaactcataggtgatgaaaggagcatttctatgagtttttgtatgtaaaagaaataaaaagaggtaagaaatgtataaatatgaaaagattaaatataattgttctttaccaattatattgcatgatttttttaatgagaattcagaagggaaattaattgaaaaacattggcataatagtcttgaaattttaattcctttatatgggaaatttgaattatggataaatgggattagtaaaatcgtaagtgcaggtaatgtatatattgttaattcaaaagatattcatgcaatcaatgctgtgaaaaatgaaaaaatatataaaggttatgctttgctaattgattatgattatttaaaaatgtgttgctcagaaatcgatataaaattttttcaacagccagatgaaaaaattaatagtagattaatgcgcacattaattgaaataattcgattttatgataacaagggtgcgtataatgatattagaataagaagttattgtcaaatgctcgtatatatattattggaaaatttagctgttgataaaaaagggtgttttaaacttaaagatagcaaatgtaaagacagaattgtaaaaattattaaatacatcgagaataattatcagaatgatttatcgttaagtattattgctaatcaatttgatatctcagaaggttatttggcaaaaatttttaaagataatttaaatttaacagttaaagaatatttaaatcaaattagactacaacatgcaaaagaggatttagtagaaaccgattatccattaatagatattgtgtataaaaatggttttccaaatataaaatcatttaataaaatttttaaagaattaaataatatgtcacctaaaatatatcgaaatatgatgaggaaatgacctttttttgatgaggaaatgccattcttacaaaaactattttatgtataatgagtatacatgtaatagaaaggggaagagatatgaaaaaatggaaacaaattacatccgctagtttattaagtgcgatgatggcgttaggaaatgtaacttcgactatggcggcaacaactgataactcaatcagccaacgtgaaaaagaaaatgctgctttagcaagagaagttgcatcagaaggaatggtattattaaaaaatgatgaaaacgcattaccaatcaaaggaaaaaatgtagcactttttggtaatagtgctgttcgtactatccgtggtggtacaggatctggagatccctttaatggtggacttagtggtggcggagatgtcatggtagatttgagtgaaagatataatattaatatttacaaagcttttgtagataaaggatataatgttacatctggtgcatttttagaagaatttgctaacggatatgatgatgctaaacttgcttttggttcaaatccaatgagtacatttgcttatccagaaatggaattaactcaaagtattattgaccaggctaaagagggaactgatacagcaatttatgtaattggaagaaatgctggtgaaggagcagatagaagttcaacaactaaaaagacaagagctacaattaatggagaagaagttgagtttgaagttggtgattacgaattaactgaaacagaaaaggctaacttggctcttgtaggtaaaaactttgataaagtaacagtagtattaaatgctggtggtgtcattgacactaaatttatggacgaaattgaggggctggatgcattgattaatatgtctcaagctggacaagaagcaggaacagcagcatttgatgttttaacaggtatagttacaccttcaggtaaattaacatctacatgggctcaaaattatagtgattatcctgcaagtgaaacatttggtggaaatgatagtgaagaaaatcttgaattatatgatgaagggatttatgcaggatatcgttatttcgacacatttaacattacaccagcgtatgaatttggatatggaatgtcatatacagattttaatatcgaagttgatggtgttgaagcaaacgaagataaagttactgtagaagcaacggttacaaatgtgggtgatacatattcaggaaaagaagtagttgaagtatattattcagcaccagatagtgatgatgcagaaaaagcatatcaagagttagctggatttgctaaaacagatgttcttggtcctggtgaatcacaaaccttgacaattacttatgaaacagaagacatggcatactataacacagatcaggcggcatatgtattggatgctggtgattatgtaattcgggttggtaattcttcaagaaatactaaagtagcaggagtaattaatttggataaagctgctaaaacagaacaattaagtaatcaattaggagatccttatcaatatggattaagtgagatatctaaagggaatactactccatataattatgctgatgaagcggaagaaattgcaaatgttaaaaaaatattaattaatgcagataatattgaatgtgtggaaaatatttctgaatataatgatgaaactgtatatacatatactagtgattcaaaatatacagcaactcaaccttatgaaaaagttgtacaagttggtgataaatctgatgcaacattactagatgtatataatggtgatgttacaatagaagaatttgtagcaaaaatgagtcttgaagaattagcaactttaaactgtggatctggttggggtgttgctaatgaaaatacacctgttgttggttctagttcagatacgattcctggggctgcaggagaaacaacggttaaatattttgatacacatggcattccatcgatagttgtagcagatggaccaggtggtattagagttaaacaagaatatgaagcaacagacgtaactactggtgaaatagaaacttattatcagtattgtacagcatggccagtatcagtattacgtggtcaaacatggaatactgaattacttgaagaagtcggacgtgcttttgcaaaagaattaaaagaaatgggtattactgtagttcttggaccaagtttaaatattcatagagatccactttgtggacgtaactttgaatactattctgaagatccattagtttctggtatgatggcaggtgctgaaacaagaggggtacaagaaacacctggtatcggagcatgtttaaaacattttgcattaaataatcaggaagcaagtcgtaatagttcaaattcagtagcaagtgaacgtactatgcgagaaatttatttaaaaggttttgaaattgcagttaagacatctcgtccaatgacaataatgacatcatacaatttaattaatggtgtaccagctgcagataattatgatttatgtactaatgttcttcgtggagaatgggattttgaaggtatggtaatgacagattggaatggtggattatcaactccaagaatttcaatgcatgcaggtaatgatatgattatgcctggtggaccttcaagagtacaaaatattgttggtggtgcaattacaatagttccagagtttgatgaaaatggacaaatcagtttaaaagaaaatttaaatatgatgtttgcatatcaagaagcagcctggggagaatttattgttgatggtgctggtcaagatacagttgttgcacaattaggtgatgattatgtagcagctgttgatgataatggtaatgttcttgttaatggtgaagtgatttatagtagatatgtatctaatatttggggtgggactggatattttactgatccagttactacagcaattgcatctgtaagtgatgatggtaaacaaattatttatcgtggtacttatttagatgacaatacaatttgtttaggtgatgttcaaaaatcagcaattaacaatttaaaagttatcataaactcaattgccatggaagctttttatggatcagataatgttacccttgaaccatgggctataaatatgtcgatgattgattatatgagtgcaacaaaatcagaggtaacattagtaaataaaacagcattagaaattgcggtagatgttgcaaacaacgtaacagaagaacaattaaataacttagtaccagcagtagctgaagaatttaaagcagccttaacggatgctctagcagtattagatgatgcagctgcagatcaagaacaagtagatgcagcatttgatagattagcaacagcaatccaaatgttagacttcatcaaaggagataaagcgacattacgttcatttgtaaataatgtaaaagatacaaaagcagatttatatataagtgtaacatggagtgcgtttgcagaagcgttagagattggaaaagtagtattagcagatgaaaatgcaatgcaagaagaagtggataatgcgtatgaagcgctagtaagagcatatttagacttaagattagtaccaaataaaaatttactagcagatctaattaatcaagcaaaaggattagtagcagctaattacacagcagaaacatggaatgctgtaagtgaagcattagcaacagcagaaatggtgatgaacaatgaaaatgcaacacaagaagaagtagataatgcacaaagtttattggcaaaagcagtagaaggactagtagcaggcagtgcaggtgagacagtaaataaaccagcagtagataatagttccacaacaatagataaagcagtaagtaagagagatacaattacaagcataaaaactggagacaacaatttaattggaatgtttggaacagttgcattgttgagcttggcaggagtaactttattaaggaaaaaggaaaattaaaaacagaataaaaatattttccctgaaaatttaaacagatccctaaaaaactcatagaaatgattttcattatctatgggtttttatatttataattagaggtcattattagctagtattaaataatttaatatttgaaaaggaaaattgttttaaacttaaaaattaatgaaatttataaaacagaattaagaaataatttaatgtctttaaagaatattcaatgcataaatatagttatataataaaagtgaataattaatttaaaaaatattaaaatgtgatgataaaatgacttttttttgatgaaaaaatagcatttttgtaaaaaaaatttatgttaatatatatataataaaaagaaaggggagtaagtatgataaaaagactatttagttgcttattgtgtactttgatgattgttgggatatgtaagataccaataatggccttagacaatcaaacggcaagtggaacacaaaaggcatatattgttggagatgactggggaccagcagtaacaaaaactgtaattgttttggataaaacaattaacagcgactcagtaagtaaagaaaaattcagtgtagtagaagaaaaacaatcttatacaaatcggccggcagcaagaacagtaacagctgcttatacatctgatgctgaaggaaataagattgaaagcagttcaaattatattacaattgaaatgtatgtttcaccaagtgaaggatcaccgttcttctatgattttattagtggaagaaatgtatggtgcaatacatataaattaaatgtatcattgatagaaggtacaacattaacagcaggtcaggaagtgattaatgccttagcaatcaaagccgatataaatgtatcagatccagcagaaagaatctgcgaacaattagatggttttgatacaactaaaacatatatggctacagacggaactgtatattcatatgcagactatgtaccagctgaagataatcagaaaaatgccttagtgatctggttacatggagcaggagaaggaggaacggatccaacaattgatttgcttgcaaatgaggtaacagcattagcagggaatgaattccaaaacttatttgaaggagtatatattttagcaccacaatcaccaacaatgtggatggatgatggaacaggagcatatcaaaatggagacaaaggatcatgctatgcagaaagtttatttgaactaattgatacttatgttaaagcaaatgatgacattgatccgaatcgcataattatagggggatgttcaaacggtggttatatgacaatggaaatgattttgaaacacccagattattttgcggcagcatatccaatctgcgaagcattccaggatcaatatattagtgatgaacaaattgaagcaataaaagatatgccaatctggtttacatatgcaaaaacagaccagacagtaaatccagaattatgtacaaaagcaacggtaacaagactgctagaagcaagagcagcaaatgtacatgtatcagtatttgaagatgtacatgatacaacaggaagatttacaaatgcagatggaacaccatatgtatatgacggacattggtcatgggtatactttgataacaacgagtgttatgatgaaaacggagtaaatgcttggcaatggttagcaaaacagacaaaagcagaagaaagtattacagatccagatagtaatgaaccatcagatgcgactttaaatagttcaacagctgttgaaggggttaaaactggagattcaacatactatgtgtcattagctgctttaatgatgctagctgcttcaggtatttatgtaagcagaagaaaagaattttaatttattaaaaagattatcaaatttttgaaaactaaaaatatctgtgatattaataaataatatctacagatattttttatttaatattcatacttgtatgaatatatgtactttaggcagttgaggatacgaagtacgcgaaataaaaaactaccagctatgtaggtggagtgataaaggtaataaatatggctcaaaaaacaaatcattagtatattgtcttcactccaaagtattatgatcaacaaaaaatgatataggagaaatattaagaacgttatgtcgattgttgtttagcgctttatattaacttgggtttatcaaattattttgactggctttttttgctgttttgactaatcagtactgtttatataacaggctattctttcactatctcagaaaatatcattcaaattgctaaatttactggatactctaatatagtaagcgtcaaattatgaggcagaatatgtaaaaatgttcaggtgaatgcttaaatataaagacggccatctaagatttatggaggactttaaagttccgtatacaaacaatgcgacggaaaagcatgtgttggaatttaaagttactgcaaagtgccaggataaaaaatgaaagggtcttaaaaattttaagaaatgtgtttcgttaatgcactttttcataatgcttattttttttatataaattatcggtaaatagatactcaaacatgaaataaaatcccgaattgcaagcagagagtggaaataagataaaaaagttctaatttttatagaaaatcgtatttttagttataccaattttagccagttctttgacaaatagctgttctgcaggaagataaccaagtatcttccttttcttttgattgattttttgattaatatctaatgttttttctttatctattgtattaatatcagttcctttctttataaaatatcttataagtccattgcagttttcatttgatgccctatcacatgaatgatatggtctcccaaaataaatctttgtacgctgttcttttgatcctggtttcttttccatatccttccatctggcaaattcatttccattatcgaatgtaatggatctgaatattttcttaaaatcgtcaccataaaatttatgaagcttattgatctgcatataaacttttttagaagattttgatgtaataggaatcatataataaaatcttgtttttctttcaatcagggtcaaataggcaccattttgtccatctcttggaccagtgacaagatcaccttcccagtgaccaaattcctctcttgtatcaacgctttcaggtctttccatgatagaagttcccttctgtcttttagggatataagttttccagttctttttcgtctttcttcttagcattctaggcagatcaattggttttatcgaaacttttccttcgtgtatgtaattatagaaagtcttagtagaaacagttaccatatttttaattttatctttttcatgaaggcgaagataattgatagtctcatcaacagaggaaagtctatttgatttcatttcattttcaacgagagtgataaaatcatgagccttatgaagtttagaattgttaggggtcttatggatcttagatcttttttcaaaggcagccaaagcagaaagttcagtacgttcattaagataggtatctctaacagtgatagtggcatccttaatgatagaatagacattagagacagaagtaccaacagaaacagccaaataatgaatgaattgagttttaccgatattacgcttatgaccagaatgcagagcgttaaaacgaataagttcattaacaataaattcataatgaaaaaactgaaggtgtttatttttagatttttgtgatatagtataagtgttcatagagagtctcctttattaggttttggtcgactaaaataatacgacttctatgaacatttttcatgtaaaaaattaaaaattgagactagagggagttggcggcgaaatgtaatgattggctagccaatcattacattaccttaattccagtttcattttacaatacacaacatgaaataaaattaaaaaaagtattgcatttatcaaatattaatgtataattcgtaagtgacgcgatatgtgttactatgcgtggaaggacactgtccatttgaccacagcacggacaaattttatataggaggttatgtcacgtgagtaaaaaagttgtaagagttatgaagattcaattccctgctgggggagctaaaccaggtccagcattagctggagcaggtatccaaatgcctaaattctgtacagcgttcaatgaccaaactaaagatcgtatgggtgaaactgtacctgttgtcttaacagtttatgaagataaagattttagttttgtattgaaaactgcaccagcagctgaaatgattaagaaagcttgcggaatcaaaaaaggttcaagcaacgctggaactactactgttgctaagttatcagctgataagttaagagaaatcgctgaatacaaaatgccagacttaaatgctaacgatatagaatcagcaatgagaattgttgctggtactgctcgtaatatgggcgttgaagttgaagcatagttaaaaaatagagaattatcgtcatttgtggaaggataatccgttagaccactaaggaggaaaagtaatggcaaagaaaagtaaaagatatcaagaagctgctaaattaattgaaaaaggtaaagcttattcaatcgaagaagcagttgcattagtaaaagaaacaagtaaagttaaatttgatgctgctgtagatgttgcatttagattaggagtagatcctcgtcaagcagaccaacaattacgtggagcattagtattaccaaacggaacaggaaaaactaaaaaagttttagttgttactgaaggagctaaagcacaagaagctaaagatgctggagctgatgttgttggtggtaaagaaattttagaagacatcaaaaaaggatggttagattttgaagttatgatcgctactcctgatatgatggctgaattaggtaaattaggtcgtattcttgggcctaaagggttaatgcctaaccctaaaacaggaacagtaactatggatgttgctaaagctgttaaagaaactaaagctggtaaagtaacttaccgtactgataaagaaggaaatgttcaattaactattggacgtgtatcattcgataatgaaaagttagtagaaaatttcactgctatctatgatttattggtaaaaatcaaaccttctacttcaaaaggtgtttatatgaaaaacattgctatctcatctacaatgggacctagcattaaagtatcagctgctaaatagtagctattaattagtcgcaatcaatatacccaagacagtaactgggaaaccttaatttgttaccgaggtgttaaagaaatatattatatatattaactttgactctcgttttacgagagttttagtttgagtatattgttgcatatatagaaaattacaggaggtgtgacaatgtcagcagaagcaattaaagcaaaaagcgcattagtcgaagaaatcgctgctaagttaaaggaagctcaatctgcagtagtagttgaataccgtggattatctgtagcagaagttacagaattacgtagaaatttacgtgctgaagatgttgaattcaaagtttataaaaacacattggttcgtagagcaactgaaataactggttatgaaggacttaatgcacaattaacaggaccaaacgcaattgcatttggtaacagtgatgctgtagcaccagcaagagtacttgcgaaattcgctaaagatcatgaggctttagtaattaaagcaggagtggttgaaggtaaaatattagatgttgatgaagttaaagaaatttctaaattacctaatcgtgaaggtatgtactctatgttgcttggtatgttacaagcaccagttagcaaatttgcgcgcgtagtaaaagctgttgcagaggctaaagaaaacggaagcactgcagaagctacagaagaagctgcaccagtagaggctgcggctagtgaagaaactaaagaagaaacagctgaataatcagctaaataaaattggaggaaaataaacatggcaaaattaacacatgaagatatcttagcttatttagaagaagctacaatcttagaattaaatgatttagtaaaagcaattgaagaaaaatttgatgtaactgctgctgcacctgtagctgtagctgctgctggagctgaagaagcatctagtgaaccagctaacgttactgtaacattaactgctcctggtggaactaaagttgctgtaatcaaagctgtaagagaaattactggattaggattagttgatgcaaaaggtttagttgataaagcaccatctgtaattaaagaaaacattcctgctgctgaaggagctgaaattaaagaaaaattagaagctgctggagcaactgtagaagttaaataatctaatttaactaataagagccctcaagggctcttttgtctttggagggaatatgaaacattattataccaataatgaagatttagtaagtgctcctgaacaatttagttttttttatcgtgataaagaattgaaatttattagcgataatggagttttttcaaaaaaaatgattgattttggttcgagggtactactagatgcaataattattgatgaaagtaaaagtagtttattggatgttggatgcggttatgggacttttggcattgctttgaaaagtgtttacccatttttacaaattgatatggttgatgtaaatgagcgggcgttatctcttgcaaaaaaaaatttacagataaataaattggatgcaaatgtatttttgagtaatgtttatgataatgttgaaggtaaatatgatttgattgttacgaatcctccgattagagcgggaaaggaaattgtgacaaaaattttggtagatgccaaagaacatttaaatccaaatggtgagatttgggtggttatccaaaagaaacaaggggctccttcggcaaaaaagaatttggaaacagtttttaaaaatgtaaatgtagtaaaaaaagataaagggtattatattttaaaggctgttaattgttaaggatggatgtaaaagcattgattattaagtaataatcaatgttttttatttgtcaatagtttttttaaaaaaagacaaaaaagttattgactttaaaatatccttgtgatagagtattaaaatgcctattaatgtttaaaatcaagcgctattgcgcgctctaaaacatgatgatagagaaaaataaaggggtggaattaatacgtggaaagtaaaataaccaaagcaaagagcaaaattactcgtcggaattattcaagaattagtggatctttagaacttccaaatttagttgagattcaaacaaattcatataaatggtttaaagaagttggaattaaggaagtttttgaagatatctacccaatcactaactttaatgagacattatcgttagaatttgtagattgtacatttgatgaagcaaaatattcagttgaagaaagtaaagatcgtgatgcaaattatgcagctccaattcgcgcatctttacgtttagttaattcagctactggtgaaattaaggaacaagaagtatttatgggtgatttcccattaatgacagattctggaacctttattatcaatggggctgaacgtgttattgtatcacaattagttcgttcacctggtgcttattttgctgatgcattagataaaagtggtaaaactgtatttaatggtagtattataccatcaagaggaacttggctagaatttgaaaatgatgctaaggatgttttaaacgtgcgtatcgatcgtaaccgaaagatgccaggaacagtattattaagagctttaggattatctagtaatgatgaaattatcgatgtttttggtgaacatgagtttattatgaatactttagctaaagataatacaacaaatatggaagaagctttgattgagatttataataaattaagacctggagaacctgctacattagaaggggctaataacttattatttgcgaaattttttgattgtaaacgttatgatttagctaaagcgggacgttttaaattcaagaaaaaattaagtcttttagatcgtatttctggacgtattttagctcaagatttagttgatattaatggtgatatagtatatccagaaggaactttgattactcaagaaattatagatgtaataaaaccagtacttgaagctggtgcccatacgcgtgaacttaataccaaccctagattagaatcaaatggtgttattcaagtgctagatgtgtatgttgatgacacaaagagtaaaaaaatgagagtaattgggacggatttatctttaaatagtaaatttgttacaatttctgatatgattgcagcatattcatatatgttcaacttagttgatatatataattctttagatttaactgctgaagatcgtgttaatttaatggcacgaatcggtttattagatgatatcgatcatttaggtaatcgtcgtgtgcgttcagtaggagaattgattcaaaatcaatttagaattggtttatcaagaatggaaagagttgttaaggaaagaatgtctttatctgaggttgattcaatcacaccacagtcattgactaatattcgaccattgacagcggctattaaagaattcttctcttcttcacaattatctcaattcatggaccaaataaatccacttgctgaattgacaaataaaagacgtttatcagcattagggccagggggattaagccgtgatcgagctggatatgaagttcgtgacgttcatgcttctcactatggtagaatttgtccaattgaaactcctgaaggtccaaatatcgggttgatttcaactttggcatcatatgctaagatcaatcaatatggttttattgaaacaccatatcgaaaggttaataattgtgttattgatgaaggcgatgtccgctatttaacagctgatgaagaaaaaaattatattattgctcaagcaaatgtaaaaactgataaagacggaactattttagatgaccaggttattgctcgtcatttaggtgagaatattatggctaagcgtgaagaagttgattttattgatatttcaccaaaacaaatcgtatcagttgcaacttcatgtatcccattccttgaaaacgatgacgcgactcgtgctttgatgggagctaacatgcagcgtcaagcagtacctttattaaatccccatacaccatttgttgggacaggaatggaatatcaggcggctcgcgattcaggagctgcagtagtagcccgtgaagatggaatagttaaatatgttgatgctaagaagatcatcgttgaagataatgaaggggtagagcatcgctatcgtttagcgaaatttaaaatttctaacaatggaacatgcattaatcataaaccaatcgtggatcttggagaaaaagttttaaaaggacaagtaattgctgatggtccagcgatggaaaaaggtgaacttgctttaggacaaaatgttttggttggattcatggaatggaatggatataactatgaagatgctgtcattatgtcagaaagattagtaaaagaagatgtttatacttcaattcatattgatgaatatgcaattgaatgtcgtgatactaaattaggacctgaagaaatcactcgtgatattcctaatgttggtgatgaggctcgtaaaaatttaaatagcgacggtatcattatgattggggcagaagttaaagaaggagatattttagttggtaaagtaacgcctaaaggacaagctgaactttctgctgaagaaaaattgttgttagctatttttggagaaaaatctcgtgaagttaaagataattcattacgagtaccacatggtggagctggaattgttcatgacattaaagtatttgaaagaaaaaatggcgatgaattacagccaggagtaaataaagtagttaaagtatatattgtacaaaaaagaaaaatttctgaaggagataaaatggcgggacgtcatggtaataaaggggtcatctcaagaatattaccaattgaagatatgccgcatttagaagatgggacgcctttagatatcatgttaaatccattaggggttccttctcgtatgaatatcggacaagtgcttgagttacatttaggatatgccgctcggcaattaggtctatatattgcaacaccagcttttgatggtttacatccaaatgatcttgaagatatcatggctgaagcaggtatgtctaaagatggtaaacaaccagtaatttctggacgtacaggtgaatattttgataataatatttcagttggaataatgtatatgatcaaattagcgcacatggtcgatgataaattgcatgcacgttctgttggaccatattcattagtaacgcagcagccattaggtggtaaagctcaaaatggtggacaaagatttggagaaatggaggtttgggctcttgaggcatatggagcagcatatacattgcgtgagattttaactgttaagtctgatgatgttgttggacgtgttaaaacttatgaagcaatcgttaaaggacagccattaccggaaccaggattacctgaatctttccgagtattgaaaaaagaattacaagctttagctttagatattcgcttattagatgaaaatgataatgaagtagacatgcgtaatattgaagaagaagagcatcgtttccctcgcagtatcgataaagatgaagtgattgaaaccccaaatactgaagatgaagttgatgaagaaatcattgaagatgatttagaagttgatgaagattgtgaagtatgtgatgaaaatgactttgaagctgatgacttcgaagaagatgatattgaagaaagtgaatcattataggagggatagagatggcaaatacaaataaattctcagcaattcaaattggtttagcttctcctcaaaagattcgcgaatggtcttatggtgaagtaaaaaagccagaaacaattaactatcgttctcaaaaaccagaaaaggacggattgttttgtgaaagaattttcggtccttcaaaggattgggaatgtagctgtggaaaatacaaaaaagtacgttataaaggtgtggtttgtgaccgctgtggtgttgaagtaactaaatcagctgttcgccgtgaaagaatgggacatattgaattagcgacacctattgctcatatttggtacttaaaaggaatcccttcaagaatgggacttattcttgatatgtcaccaaaacagcttgaagaaattatttattttgtttcttatgtagttattgataaaggaagtacgcctttagaatataagcaggtattatctgaaagagactatcgtaaatgttttgaacagtttggtcatacttttgaggctaagatcggtgctgaagcaatccaaacattattaaaacaagtggatcttgatgctgaatttgaaaaagtaagcaaagaattaaaagaggctcaaggtcaaaagagaacaaaattattgaaacgattagaagcgatagaagcttttagatcttcagaaaatcaaccagaatggatgattttagaagctttacctgtaataccaccagatttacggccaatgttacaattggatggagggcgtttcgctacttctgatttaaatgatttataccgtcgagttattactcgtaataatcgtttaaagaaattattggaattagggactccatctatcattgttcaaaatgaaaagagaatgttacaggaagcagtagatgcattaattgataacggacgtcgttctaaaccaattactggagctgggggacgtgccttaaaatcattaagccatactttaaaaggaaaacaaggacgtttccgtcaaaacttgcttggtaaacgtgtcgattattcagggcgttctgtaattgcagtcggtccagatttaaaaatgtatcaatgtggtattcctcgtgaaatggcactaaatttattcaaaccgtttgtaatcaacggattggtaagagatcaattggcaactaatattaaagctgctgaaagattgattgaaaaaatggatgatcgcatttggccaatcgtagaagaggtaatcaagcagcatccagtattattgaatcgtgcacctactcttcacagattaggaatccaggcttttgagccaaagttagttgaaggacgagcaattcgtctacacccattggttactccagcatttaacgctgattttgatggtgaccaaatggctgtccatgtaccattaggtgaagaggctattcaagaagcacgtcaattaatgttagggtcaaataatattttgggacctaaagatggtaagccgatcgttacgccttctcaggatatggtattaggtaattattatttaactttagaagatgtagatggtattggtgaaggtactgtttttgctgatcgtaatgaagtcgatcatgcttattttgcaaaaacagttggattgcatacgagagtggcaattaaagcttctgctttaaataatagtacatttacagaagctcaaaataaatgttatttaattacgactgttggtaagattctatttaatgatatctttgatggacaattcccatttatcaatgatccaagtagtgaaaatttaattgcaacaccagataagtattttgtaccaatgggaacaaatatcaaagaacatatcaaaaagcagccaattattaagcctttaaataagaaatctttaggaaaaataattgatgaagtatttaaacatcaagcgatgtcagatactagtttgatgcttgataagttaaaagatcaaggtttctattattcgactattgcgggaacaactgtatctgtatacgatattcaggttcctcatgcaaaatatgaaatttttgaaagagctgatgaaaagcttgagcaaatcaaaaagttctataataagggtaaattaacagaatctgaaagatatcaaaatgttattaaattatggacggatgtcaaagatgaggttcaagaagtagttcgtcaagaattcgaagctgatgatcgaaatccaatcttcatcatgtcagattctggagcccgtggatctttatcaaactttacacagttagttggtatgcgtggattgatgtctaacccaaaaggagaaacgattgagttacctatcaaatcttcgtttagagaagggttaacagcatcagaattctttatttctacccatggtgctcgtaaaggatctacagatacagcgttaaagactgcagattcaggttatttaacaagacgtttagttgacgttgcacaagaagtaattatttctgaagaagattgtggaacggatcgtggctttattgttacagagttatacaataatgatgataaatcagttattgtaccattgcgagatcgtttagtaggacgtttttcacaaaaagatattttccatccagaaactcgtgaattaattgtcgctggaggagagttgattacagaagcgatagctgatgatattgttaatgctgatattaaagaggttgaaattcgctcagttcttggatgcagcgctaaaggtggtatttgtcgaaaatgctatggtcgtaatttagctactggagatgttgttgaacttggtgaagcagtaggaattatggcggctcaatcaattggagaacctggtacccaacttacaatgcgtactttccatgacggtggagtagctggtggtgctgatattacacaagggttaccacgtattcaagaattatttgaagctcgtaatccaaaagcaaaatcaattattagtgaaattgaaggtgaggtaactaatttaattgataatgctggaagaatggaagttgtgattactaatgatttggaaacacgcagctatttagctccttatggtgctaaaattagagttggagttggagatcatatcaatattggtgataagattacaaagggatctatcgatccaaaagagttgttatcagttgctgatgttgaagctgttgaaaactatattattaaagaagttcaaaaggtttatcgtattcaagggattgaaatttctgataaacacatcgaaattattgttaaacaaatgttaagaaagatgaaagtgatagaaggtggcgatacgggatgtctacctggtactaatattaatgtcaatgcatttacagagttaaaccgcgatgttttgagatctggtaaacatcctgctgttgcaagaccagtattacttggaatcacaaaagcttctcttgaaacagaatctttcttatctgctgcatcattccaagaaactacaaagattttaaccgatgcatcaattaaaggtaaaaaagatttattaaaaggattgaaggaaaatgttttaattggaaaattattaccggctggaacaggacttcgtggacctttgaaatctcctgaaactttaaaacgtgaagccgaagaagctttcgctgcaagtcaggaagtagttgatgaatctattgatgaatcagaaattgtatctgaggataatgaagtgatagaacaagcaggataatcctgcttgtttttaattgtgaaacaaaatatcacgtgctatgcacatgataacaataatattaaagtatgagatataagattggatgtataaacttgtataagaaaaaataaaaaaagtaaaaaatatgttgacataaacaagtaaatagattattatgatttacggtgctcgttatggagcgcgttgtttattacgaaatatgaaacacccggtattgtgtgtttgaatatggaagaaaggagaaaagtaatgcctactattaatcaattagtaagacaaggtcgtaccgacaaaactacaaaatcaaaatcaccagcgttaaacagaggttttaactcattggctaaaaaaccaacaataactaattcacctcaaaaacgtggtgtttgtactcgtgttgctaccatgacacctaagaaacctaactcagctttacgtaaatatgcccgtgttagattatcaaatggtatggaagtaactgcatatattccaggaattggacataacttacaagaacatagtgttgttttaattcgtggtggtcgtgttaaggatttaccaggggttcgttatcacattgtacgtggtactatggactgtgctggagttaacaatcgtaaacaaggccgttcaagatatggtgctaaaaaaccaaaagcttaaaatcaagtataggaggaaaattaaatggcaagaaaaggtcaagttgctaaaagagacgttctacctgatccagtgtacaattctaaaactgtatctaaattaatcaacaacattatgcttgatggtaaaaaaggtgtagcgcaaaacatcttatatgatgcatttaaaaaagttgaagaaaaaactggaaatccagcaatggaagtttttgatcaagcaattaacaatattatgccagttcttgaacttaaagttagacgtattggtggggcaaactaccaagtaccagtagaagtttctggggaaagaagaatgactttaggattaagatggttagttaattattctcgtttgagaaatgaaaatacaatggttgatcgtttagctaacgaaatcattgacgcttctaatggagctggggcttctgttaagaagaaagaagatacacataaaatggcagaagctaataaagcatttgctcatttccgttggtaatatccaaccaaaaattaagaaaggagaaaaattatgtctcgtgaattctcgttagaaaaaactcgtaatataggaatcatggctcatattgatgctggtaaaacaacaacaactgaacgtgttctttattacacagggaaaatccacaaaattggagaaactcatgaaggggcttctcaaatggactggatggaacaagaacaagaacgtggtatcacaattacatctgcagcaactactgctcaatggaatggatatcgtgttaatattatcgatacaccgggccatgttgacttcactgtagaagttgaacgttctttacgtgtattagatggtgccgtgactgtattagactctaaagctggtgttgaacctcaaactgaaacagtttggcgtcaagctacaacttatggagtacctcgtattgtattctgtaataaaatggatgctactggagctgactttattatgtctttagaatctttagataagagactaggagtgcatggtgtagctattcaattaccaattggtgctgaagatacatttgaaggtgttatcgatttaattaaaatgaaagcagtatattttgaaggggataaaggtgaaaacgttgtttataaagatattcctgaagaatatatggctcaagcagaagaatatcgtgctaaaatgttagactctgctgctacttatgatgatgatttattaatgaaagtcttagaaggtgaagaaccaacagaagatgaaatcaaagcagctatccgtaaaggggttttagcagttgaattattcccagtattatgtggatctgcttataaagataaaggtgttcaaccaatgttggatgcagttatcgatttcttacctgcacctactgatattccatcaattaaaggtgttgatgaaaatgaaaatgaaattgaaagacatgcttctgatgaagaaccatttgcagcattagctttcaaaatcatggctgatcctttcgtaggtaaattaacattcttccgtgtatattcaggaactgctgaagctggaagttatgtattaaattcaacaaaagacaaaaaagaacgtttaggacgtattcttcaaatgcatgctaataaacgtaatgaaattagtacagtatatgcaggagatattgctgctgcagtaggttttaaaaatactacaactggtgatactatttgtgacgaaaagaatttcgttattcttgaaaaaatggaattcccagaaccagttattgaacttgctattgaaccaaaaacaaaacaagatcaagataaacttggtacaggattagcaaaattagctgaagaagatccaacatttaaaacttatacaaaccctgaaacaggtgatactgtaattgccggtatgggtgaattacacttagatgtaattgttgatcgtttaagaagagaatttaaagtagaagctaatgtaggagctccacaagttgcttatcgtgaaacaattactcaagcagctgattgtgaaggtaaatatgttaaacaatcaggtggtcgtggacaatatggtcacgtatggattaaatttgaacctaatgaaggtaaaggatttgaattcgttgatgcagttgttggtggtgctgtacctagagaatatatcaactcagttaaagtgggtctagaagatgcactagaaacaggtatgattgctggatatccagttttagatgttaaagctacattatttgatggatcataccatgatgtcgattcatcagaaatggcttataaagtagctgccagcttagcacttaaagctgcaggtaaaaaatgtgctccagttattttggaaccaattatggctgtggaagttgttgccccagctgaatatttaggtagtgttatgggtgacgtatcttcacgtcgtggtatgatcgaaggacaagaagaaagaggaaatgctatttctgttcaagcatctgtacctttatcagaaatgtttggttatgcaacagatttacgttcatttactcaaggtcgtggtaactatactatgagatttgatagatatgaacctgtaccaaaatctattagagaagaaattattaagaaaaacggtggaaacgattagcaccaattaaaatcttattgattttttcaaataaataaattagaatgtatatgtacaaaaatataaattaggaggaaccttaaatggctaaggaaaaatttgaccgctctaaagcgcatgtaaatatcggaactattggtcacgttgaccatggtaaaacaactttaactgctgctattacaacagttttatcaaaagaagggcaagcacaagctatggactatgcttcaatcgatgctgctccagaagaaaaagaacgtggtatcacaatcaacactgcacacgttgagtatcaaacagctactcgtcactatgcacacgttgactgtccaggtcatgctgactatatcaaaaacatgatcactggtgctgcacaaatggatggagctatcttagtagttgctgcaacagatggtcctatgcctcagactagagaacatatcttattatctcgtcaagtaggtgtaccttatattatcgtattcttaaataaatgcgatatggtagatgacgaagaattattagatttagtagaaatggaagttcgtgaattattaagcgaatatgatttcccaggtgatgacactccagttatccgtggttctgcattaaaagctttagaaggagatccaaaatgggttccagctattcatgaattaatggaagctgtagatacttatattccaactccaactagagatacagataaaccattcttaatgcctgtagaagacgtattcactatcacaggacgtggtactgttgctactggacgtgttgaacgtggacaattaaaattaaacgatcctcttgaaatcgttggtatccatgaaactcaaaatacagtagctactggtattgaaatgttccgtaaattattagattatgctgaatcaggagataacgtaggggttttattaagaggtatcaaccgtgatcaaatccaacgtggacaagttttagctaaacctggatcagttaatccacacaaaaaatttaaatctcaagtatatatcttaagtaaagatgaaggtggacgtcatactcctttcttcgctaactatagacctcaattctacttcagaactactgatgtaactggtgtaatccaattaccagatggtgtagaaatggttatgcctggggataatgttgaattaactgtagaattaattgcaccaatcgcaattgaaaaaggaactaaattctcaatccgtgaaggtggtagaactgtaggttctggaaatatttctgatattattgaataatatatcaaataaaaagggagtcattatggcaatgtcattatgaactcctttttgttttttatatttgtatatagattatgtatattatgttagttatatttagcaaaaaataatcgaagagaaaggtcctatctgataattataggtgtaaaaataattggtattaagtcaataaagatgtaaatacctatgaatattttaaagtaaaaagagttaataaaaataaggcgatttgtattgaaaatatgtgtctagaagttatcgtaagaagttgtatttaattgaaaataacagtataatcggtatttcttttacattttgaaaatcattgaaaccgcttgaaaatgatatgtcagttgggtataatataagggcagatgtatttctgaaaatttgtgttataaggagaaatcaaaatggatgaacaagaacaaatagtaattaatctaattgtaaacagcggtagtgctcgtagttctgcaattgaagctattcagtacgctaaagctggtgatttagaaaaggcagatgaatctttacaagctgctaaagaaacagttaatgaagctcatcattcacaaacagaattaattcaagctgaaattcgtggtgaaaaatcaccattaaatttactaatggtacatgctcaagatcatttgatgactgcattagttgttattgatttagcacaagaatttattgatgtttataaaaaaattggttaataaggatttagtaattccatctcttgtttaaggggtggttttttattgaaaaaacagttttaatttaaaagtagataaagagtgcaaaaagtaaagaaaaaaactgtagtgaaaagttaaattctatttatcataacatatataacttatattttttgagaaaataagattttaggtgaatttgtctttttattttaaaaatatcttatttgatgaatccttcatatatcacattatttagaaattttatcattgcatttagtctttgagattttattaattcagtaagtcttaaagttctgaatcagtatattaggaaatacatatttgaattccttatagttgttttcaaaaccttagcgtgcttataaaagtatcatgagtaagagcatcatatgactgggttaaagcattagacatatttctttttgttttattttcgtaagatagaacaatgataaaaattcaaacgtacaaataaaaaatgcacaatgcatcagttaaaacaagcgtaagaattattttgttgagaactatttaagttatgagttattattttgccccgaattgcaagcagagagtggaaataagataaaaaagttctaatttttatagaaaatcgtatttttagttataccaattttagccagttctttgacaaatagctgttctgcaggaagataaccaagtatcttccttttcttttgattgattttttgattaatatctaatgttttttctttatctattgtattaatatcagttcctttctttataaaatatcttataagtccattgcagttttcatttgatgccctatcacatgaatgatatggtctcccaaaataaatctttgtacgctgttcttttgatcctggtttcttttccatatccttccatctggcaaattcatttccattatcgaatgtaatggatctgaatattttcttaaaatcgtcaccataaaatttatgaagcttattgatctgcatataaacttttttagaagattttgatgtaataggaatcatataataaaatcttgtttttctttcaatcagggtcaaataggcaccattttgtccatctcttggaccagtgacaagatcaccttcccagtgaccaaattcctctcttgtatcaacgctttcaggtctttccatgatagaagttcccttctgtcttttagggatataagttttccagttctttttcgtctttcttcttagcattctaggcagatcaattggttttatcgaaacttttccttcgtgtatgtaattatagaaagtcttagtagaaacagttaccatatttttaattttatctttttcatgaaggcgaagataattgatagtctcatcaacagaggaaagtctatttgatttcatttcattttcaacgagagtgataaaatcatgagccttatgaagtttagaattgttaggggtcttatggatcttagatcttttttcaaaggcagccaaagcagaaagttcagtacgttcattaagataggtatctctaacagtgatagtggcatccttaatgatagaatagacattagagacagaagtaccaacagaaacagccaaataatgaatgaattgagttttaccgatattacgcttatgaccagaatgcagagcgttaaaacgaataagttcattaacaataaattcataatgaaaaaactgaaggtgtttatttttagatttttgtgatatagtataagtgttcatagagagtctcctttattaggttttggtcgactaaaataatacgacttctatgaacatttttcatgtaaaaaattaaaaattgagactagagggagttggcggcgaaatgtaatgattggctagccaatcattacattaccttaattccagtttcattttacaatacacaagttattattttgcttaaaaaaataaaaataatactttacaaagagggagagatatggtaaattaaggaggcactcaagagaagggataaagtaacccgaagaaaaagaaaaaaaagtaaaaaaaagattgactaaaaagagaaaagagtgtaagataatcgagtcggcgaaagaagccggagagatcattgaaaactaaacagaattaagaaacacacgtcaaagaaggatccggaaacggatagaagagaaaaagaagagctaaacaaacgaaagattgtaaagataaagagacaatggagagtttgatcctggctcaggatgaacgctggcggcgtgcctaatacatgcaagtcgaacgcgggcagcaatgcccgagtggcgaacgggtgagtaatacataagtaacctgccctttacagggggataactattggaaacgatagctaagaccgcataggtaaagataccgcatggtaagtttattaaaagtgccaaggcactggtagaggatggacttatggcgcattagctagttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaggaaggtcttcggactgtaaacttctgttataaaggaagaaaggcggatacagggaatggtatccgagtgacggtactttatgaggaagccacggctaactacgtgccagcagccgcggtaatacgtaggtggcaagcgttatccggaattattgggcgtaaagagggagcaggcggcagcaagggtctgtggtgaaagactgaagcttaacttcagtaagccatagaaaccgggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttgggagtcaaatctcagtgctgcagttaacgcagtaagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagatatatgggatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggagcagagggaagcgaagccgcgaggtggagcgaaacccagaaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgcaaggagggagctgtctaaggtgggattgatgattggggtgaagtcgtaacaaggtatccctacgggaacgtggggatggatcacctcctttctaaggagaaagaagagaagtgaagtttcattaatactgtttagttttgagtgatgctcaggaggagtattgcttaaaagagatcattgaaaactggataatagaagaaatttgcgatagaaaagaagagatcgagataagaagattattgaggtctttctagagaagtcgaaaactaagaaaagaatcactgaagagacgaaagtaaatagtaaagtgatcaagaacaccaataggtaaagtaagaaagagcgtatggcggatgcctaggcacagagaggcgaagaaggacgcagcaaacagcgaaatgcgacggtaagcagtaagcatgcgaagagccgtcgatatccgaatgggggaacccacccggagtagagaccgggtatcctgaagtgaaaaaatagcttcagagaggtgagactcagggaactgaaacatctaagtacctgaaggaagagaaaataaagaaatgattccctaagtagtggcgagcgaaaggggaggagcccaaaccgatccaaggatcggggttgaaggactgtcgagaaagagcaagaagacattatagacgaacggaatgggaagtccggcgaaacagggtgagagccccgtagtcgaaatagtgaggaagcttgagacagcacctgagtacggcgggacacgaggaatcctgtcggaatcagccaggaccatctggcaaggctaaatactactctgtgaccgatagtgaaccagtaccgtgagggaaaggtgaaaagaaccccgggaggggagtgaaagagaacctgaaaccatatgcttacaagaagttagagcccgttaaagggtgatagcgtgccttttgtagaatgaaccggcgagttacgatatggagcgaggttaagcaggatatgcggagccgaagcgaaagcgagtcttaagagggcgaaagttgcatgtcgtagacccgaaaccgagtgatctagccatgaccaggttgaagttggggtagaacccgatggaggaccgaaccgacccccgttgaaacgttggcggatgagttgtggctaggggtgaaattccaatcgaactcggagatagctggttctccccgaaatagctttagggctagcgtcgagagaggtcaagtgaaggtagagcactgaatatgtgatggccccatcccggggtactgaatataatcaaactccgaatgtcacagagacaggctcggcagtcagacagcgggtgataaggtccactgtcaaaagggaaacagcccagaccatcagctaaggtcccaaaatatatactaagtggaaaaggatgtggagatgtccagacaactaggaggttggctcagaagcagccatcctttaaagagtgcgtaacagctcactagtcgaatgactctgcgccgataatttaccggggctaagtatattaccgaagctatggatttacagagatgtaagtggtaggggagcgttctataggcggagaagctgtaccggaaggagcagtggagcgtatagaagagagaatgccggtgtgagtagcggaacgcgggtgagaatcccgcgcaccgaaaacccaaggtttccagaggaaggttcgtccgctctgggtaagtcgggacctaaggcgaggccgagaggcgtagtcgatggacaacaggtagagattcctgtacttacggtatgaatgaaggagtgacggagcaggctagcgcatcctggagctggaaaagcaggtgcaagcgaggtagctgacaaccaggcaaatccggttgtcgaaaggcgaaggcgtgaagcggatggaaagctaaggcgagtacagaagagcgtgaagcaagcttccaagaaaagcttctagtgctaatcatacagtaacccgtaccgaaaatggacacacatgggtgaggagagaatcctaaggtgagcgagagaactatagctaaggaactctgcaaaatgactccgtaacttagggagaaggagtgctcatagagatatgagccgcagtgaaacggcccaagcgactgtttaccaaaaacacagctctatgctaagtcgaaagacgacgtatatggggtgacgcctgcccggtgctggaaggttaagaggatgtgtcagcgcaagcgaagcactgaattgaagccccagtaaacggcggccgtaactataacggtcctaaggtagcgaaattccttgtcaggtaagttctgacccgcacgaaaggcgtaacgatttgggcgctgtctcagctgtagactcggtgaagtcttagtacctgtgaagatgcaggttacccgcgactagacggaaagaccccatggagctttactgcagcttgatattggactttgatgcaggatgtacaggataggtaggagacgaagagacatgcacgccagtgtgtgaggagtcgctgttgggatactactcttcgtgtattggagttctaaccggatgccataaactggtgacgggacagtgtcaggtgggcagtttgactggggcggtcgcctcccaaagagtaacggaggcgcccaaagataccctcagcttggatggaaatcaagcgcagagtgcaaaggcaaaagggtgtttgactgcgagaccaacaagtcgagcagggacgaaagtcgggcttagtgatccggcggtgctgaatggaaaggccgtcgctcaacggataaaagctaccctggggataacaggctgatctcccccaagagttcacatcgacggggaggtttggcacctcgatgtcggctcatcgcatcctggagctgaagtcggttccaagggttgggctgttcgcccattaaagcggtacgcgagctgggttcagaacgtcgtgagacagttcggtccctatctgtcgtgggcgtaggaagtttgagaagatctgtcctcagtacgagaggaccgggatggacatatcaatggtgcaccagttgtcacgccagtggcacagctgggtagctaaatatggaagggataaacgctgaaggcatctaagtgtgaaacccacttcaagatgagacttcccaaaacgcaagtgagtaagaccccttaaagacgataaggtagataggtcaggagtgtaagcatggcgacatgttaagcggactgatactaataggtcgaggacttaacctaaagagaaggttggagacgagcaaatggaaggaactattatccggttttgagtgattctcgaaaggaattgcttaaagagaagagatctggtagcgatagcatgatggacacacctgtacccataccgaacacagaagttaagcatcataacggcgaagatagtactgcggtgcgaaaatagcaagctgccggttctttttttattttggatacctcgggtatcctttttttgtattaggcaaaaaatcaaggaaaaaagtaaaaaaataaaaataatactttacaaagagggagagatatggtaaattaaggaggcactcaagagaagggataaagtaacccgaagaaaaagaaaaaaaagtaaaaaaaagattgactaaaaagagaaaagagtgtaagataatcgagtcggcgaaagaagccggagagatcattgaaaactaaacagaattaagaaacacacgtcaaagaaggatccggaaacggatagaagagaaaaagaagagctaaacaaacgaaagattgtaaagataaagagacaatggagagtttgatcctggctcaggatgaacgctggcggcgtgcctaatacatgcaagtcgaacgcgggcagcaatgcccgagtggcgaacgggtgagtaatacataagtaacctgccctttacagggggataactattggaaacgatagctaagaccgcataggtaaagataccgcatggtaagtttattaaaagtgccaaggcactggtagaggatggacttatggcgcattagctagttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaggaaggtcttcggactgtaaacttctgttataaaggaagaaaggcggatacagggaatggtatccgagtgacggtactttatgaggaagccacggctaactacgtgccagcagccgcggtaatacgtaggtggcaagcgttatccggaattattgggcgtaaagagggagcaggcggcagcaagggtctgtggtgaaagactgaagcttaacttcagtaagccatagaaaccgggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttgggagtcaaatctcagtgctgcagttaacgcagtaagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagatatatgggatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggagcagagggaagcgaagccgcgaggtggagcgaaacccagaaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgcaaggagggagctgtctaaggtgggattgatgattggggtgaagtcgtaacaaggtatccctacgggaacgtggggatggatcacctcctttctaaggagaaagaagagaagtgaagtttcattaatactgtttagttttgagtgatgctcaggaggagtattgcttaaaagagatcattgaaaactggataatagaagaaatttgcgatagaaaagaagagatcgagataagaagattattgaggtctttctagagaagtcgaaaactaagaaaagaatcactgaagagacgaaagtaaatagtaaagtgatcaagaacaccaataggtaaagtaagaaagagcgtatggcggatgcctaggcacagagaggcgaagaaggacgcagcaaacagcgaaatgcgacggtaagcagtaagcatgcgaagagccgtcgatatccgaatgggggaacccacccggagtagagaccgggtatcctgaagtgaaaaaatagcttcagagaggtgagactcagggaactgaaacatctaagtacctgaaggaagagaaaataaagaaatgattccctaagtagtggcgagcgaaaggggaggagcccaaaccgatccaaggatcggggttgaaggactgtcgagaaagagcaagaagacattatagacgaacggaatgggaagtccggcgaaacagggtgagagccccgtagtcgaaatagtgaggaagcttgagacagcacctgagtacggcgggacacgaggaatcctgtcggaatcagccaggaccatctggcaaggctaaatactactctgtgaccgatagtgaaccagtaccgtgagggaaaggtgaaaagaaccccgggaggggagtgaaagagaacctgaaaccatatgcttacaagaagttagagcccgttaaagggtgatagcgtgccttttgtagaatgaaccggcgagttacgatatggagcgaggttaagcaggatatgcggagccgaagcgaaagcgagtcttaagagggcgaaagttgcatgtcgtagacccgaaaccgagtgatctagccatgaccaggttgaagttggggtagaacccgatggaggaccgaaccgacccccgttgaaacgttggcggatgagttgtggctaggggtgaaattccaatcgaactcggagatagctggttctccccgaaatagctttagggctagcgtcgagagagaggtcaagtgaaggtagagcactgaatatgtgatggccccatcccggggtactgaatataatcaaactccgaatgtcacagagacaggctcggcagtcagacagcgggtgataaggtccactgtcaaaagggaaacagcccagaccatcagctaaggtcccaaaatatatactaagtggaaaaggatgtggagatgtccagacaactaggaggttggctcagaagcagccatcctttaaagagtgcgtaacagctcactagtcgaatgactctgcgccgataatttaccggggctaagtatattaccgaagctatggatttacagagatgtaagtggtaggggagcgttctataggcggagaagctgtaccggaaggagcagtggagcgtatagaagagagaatgccggtgtgagtagcggaacgcgggtgagaatcccgcgcaccgaaaacccaaggtttccagaggaaggttcgtccgctctgggtaagtcgggacctaaggcgaggccgagaggcgtagtcgatggacaacaggtagagattcctgtacttacggtatgaatgaaggagtgacggagcaggctagcgcatcctggagctggaaaagcaggtgcaagcgaggtagctgacaaccaggcaaatccggttgtcgaaaggcgaaggcgtgaagcggatggaaagctaaggcgagtacagaagagcgtgaagcaagcttccaagaaaagcttctagtgctaatcatacagtaacccgtaccgaaaatggacacacatgggtgaggagagaatcctaaggtgagcgagagaactatagctaaggaactctgcaaaatgactccgtaacttagggagaaggagtgctcatagagatatgagccgcagtgaaacggcccaagcgactgtttaccaaaaacacagctctatgctaagtcgaaagacgacgtatatggggtgacgcctgcccggtgctggaaggttaagaggatgtgtcagcgcaagcgaagcactgaattgaagccccagtaaacggcggccgtaactataacggtcctaaggtagcgaaattccttgtcaggtaagttctgacccgcacgaaaggcgtaacgatttgggcgctgtctcagctgtagactcggtgaagtcttagtacctgtgaagatgcaggttacccgcgactagacggaaagaccccatggagctttactgcagcttgatattggactttgatgcaggatgtacaggataggtaggagacgaagagacatgcacgccagtgtgtgaggagtcgctgttgggatactactcttcgtgtattggagttctaaccggatgccataaactggtgacgggacagtgtcaggtgggcagtttgactggggcggtcgcctcccaaagagtaacggaggcgcccaaagataccctcagcttggatggaaatcaagcgcagagtgcaaaggcaaaagggtgtttgactgcgagaccaacaagtcgagcagggacgaaagtcgggcttagtgatccggcggtgctgaatggaaaggccgtcgctcaacggataaaagctaccctggggataacaggctgatctcccccaagagttcacatcgacggggaggtttggcacctcgatgtcggctcatcgcatcctggagctgaagtcggttccaagggttgggctgttcgcccattaaagcggtacgcgagctgggttcagaacgtcgtgagacagttcggtccctatctgtcgtgggcgtaggaagtttgagaagatctgtcctcagtacgagaggaccgggatggacatatcaatggtgcaccagttgtcacgccagtggcacagctgggtagctaaatatggaagggataaacgctgaaggcatctaagtgtgaaacccacttcaagatgagacttcccaaaacgcaagtgagtaagaccccttaaagacgataaggtagataggtcaggagtgtaagcatggcgacatgttaagcggactgatactaataggtcgaggacttaacctaaagagaaggttggagacgagcaaatggaaggaactattatccggttttgagtgattctcgaaaggaattgcttaaagagaagagatctggtagcgatagcatgatggacacacctgtacccataccgaacacagaagttaagcatcataacggcgaagatagtactgcggtgcgaaaatagcaagctgccggttctttttttattttggatacctcgggtatcctttttttgtattaggcaaaaaatcaaggaaaaaagtaaaaaaataaaaataatactttagagtgcttgttatttcaatgagggtaataaaagtatgagccttgacaagtttagaattgttaggaatcttatgattcttcaatctttttttaagacagccaagcagaagaatcagtatgtccattgagaaaagcatctttaacagtaatagtggcataattactaatagaatggacattaaaaacaagagtattaatagaaacagataaaaattcaatgaattgagttttattagtattacgtttatgttaatatgtactgcattaacccgattaggtgttgacaataaattcatagtaaattgaaaatatttatttttagttttttcgcgatttagtataggtgttcatatatagttttgtttatttggttttgatcgactaaaataaatacaatttctatgaacagttttatgtaaaaatgaataacgaatcttaagagacagcaaagaaatataaaaatgacgaattgatttttacagtctcttaattccagtttcattttacaatacacagattaaaataaacttgaaataaatacaaaaaaaccttgcaatgaggcatcttttttgttaaaatatcaccgttggcgttgcgtagatgtgcgaggttgctgaaacaccgaagagcgttgtcatgaaacggcatgtttcagggaattcgtattgagcaagtcaaatcctatgaagttgaaaggagaaaaatcatggcaaataataaaattagaattagattaaaatcgtttgatcacaaaattctagataactcagcagaaaaaatcattggtgctgctaagaaatctggagcacaagtagtaggaccagttcctctaccaacagaaaaagaaatctatactattttaagagctgttcacaaatataaagattctcgtgaacaattcgaaatcagaactcacaaacgtttaatcgatattgttaatcctacacaagaaacagttgatattctaacaagattagaattaccaagtggtgtagacattgaaattaaattataagaaaggtaaatggtgtaactcatgaaaggaatcttaggtcgtaagattggaatgactcaagtcttcacaactgatggtttattaatccctgtaactgtagtagaagctactgaaaatgttgtattacaaaagaaaacagttgcaactgatggatatgatgctattcaagttggatttgaagataagagagaaaaattagctaataaagctgaattaggtattgtaaagaaagctaacacagctcctaagcgcttcatcagagaatttcgttatgacgaaatgatgagttatgaagttggagataaaattacagttgatagcttcgtagctggtgaagttgtggatgtaactggaacttctaaaggtaaaggttatcaaggtgttattaaaagacatggacaacatatcggtccaaaaggacatggttcaggagctcatagaattgttggttcaatgggaccaattgctccaaacagaattgctccaggtaaaaagttaccagggcaaatgggacatgtaacaagaacagttcaaaatttagaaattgtggctgttgatgtagaaaataatttattattaatcaaaggttcagtaccaggacctaaaaaaggattagtaattgtaaaatctggaattaaagcagctggtaaggtaaatgaagcttatgaattagtagatttcacaccagcagtagaagaaactaaagaagcagatgcagcaactgaaacagcagttgaagcagctgaataatttagggaaggaggattcgatatgcttacagttaaagtatataaccaagaaggttctgaagtaaaagatttagaattaaatgaagcggtatttggaattgaaccaaataaacaagcattatttgatatggtcttattacaaagagcatcattaagacaaggtactcataaagtaaaaaaccgtactgaagttcgtggtggtggtaaaaaaccatggcgtcaaaaaggtactggtagagctagacaaggatcaatccgtgcaccacaatggcgtggaggaggagttgtatttggtccaacacctagaagttataaatttaaattaaatcgtaaagttagaagattagctcttaagtcagcattatctactaaggttaacgataacgaattcatggctttagaagctattaaattcgatgctccaaaaactaaagaaatggttaaagtattagctaatttagaagcaccagctaagacattaatagttgtagacgaaatttgtccaaatgttgctagaagtgctaataatattccaggagttaaattattagatgcaaaacatgtaaatgtttatgatatattaaacagcaataagttaattatgactgaagctgctattaaatctgttgaggaggtactaggataatggcacacattacagatgtattgaaaaaacctgtacttactgaaaaatcaatgacccttcaagcagaagaaaacaaatacacatttgatgtagatgttaatgctaataaaattgaaattagacaagctgtagaagcaatgtttgatgtaaaagttgaaagtgttaatgtaatcaatgttagacctaaatcaaaaagagtaggtaaatacgaaggtaaaactaaccgtagaagaaaagctattgttaaattagctgaaggtagtgaaattagttatttcggtgaggaataatcgataaaatattggaatacataattccagataaataggaggaaactaaagatggcaatcaaaacttataagccagtgactaatggtcgtcgtaatatgacttcattaacttttgaagaaattacaacaaataaacctgaaaaatctttagttgcaaaagtaagtaaaaacggtggtcgtaataaccaaggtgttattacaactcgtcatcatggtggaggacataaacgtaaatatcgtattattgatttcaaacgtaataaagatgatatcgttggaactgttgcaactatcgagtatgatccaaatagatcagcaaacatagcattgatcaactatgcagatggtgaaaaaagatatatcttagctccaaaaggattagaagttggaagcaaaatcatatctggtgaaaatgccgatatcaaagtaggaaatgctttaccaatgggaaatatgcctgaaggtacagtaattcacaatattgaaatgcaacctggtaaaggtggacaaatcgcacgttctgctggtgtgtctgctcaaatcttaggtaaagaagaaagatatgtaattgtcagattagcatctggtgaagtacgtaaattattagctgtatgtagagcaactgttggagttgttggaaatgaagaccatggattagttaactatggtaaagctggacgtatgagatggaaaggtgtaaaacctactgtacgtggttctgtaatgaatcctaacgaccatcctcatggtggtggtgaaggtagaacttctatcggacgtaaggctccaatgacaccttggggtaaaaaagctatgggtgttaaaactagaaaaaataagaaagcgtctactaaattaattgtacgtcgcagaaattctaaataataagaggaggaagaaataatggcacgtagtttaaaaaagggaccatttgttgatgaacacttaatgaaaaaagttgaagcattaaatgcgtcaggtaaaaaagaagttatcaagacttggtctagacgttcaacaatcttccctcaatttattgagcacacatttgcagtgtataatggaagagaacatatcccagtatatgtaactgaagatatggtcggacataaattaggagaattcgctccaacaagaacttatcacggtcatagtgctgatgataaaaaagctggaaaatagagagaggagaatttaaaacatggaagcaagagctcaagctaaaatgattcgtgtttcacctcaaaaagcaagattagttgttgacttagtgagaggtaagcaagttaaagaagcacttggtatgttagaatatgttaataaaagtgcaactcctgcaatcattaaagttgtaaaatctgctgcacaaaacgctgtttataataacggtgctgaagcagaaaagttatatattaaagaaatctatgtagatgaaggtcctacattaaaaagattcgctgctagagcaaaaggtagcggaacaagaattttaaaaagaactagccacatcacttgtgtggtagaagaaagataggaggtcacattatgggtcaaaaagtaagtccaattggtttgcgagttggaattaaccgtaattgggattctagatggtatgctaacgatcaagattttgcaggtctattacatgaagacatcaaaattcgtgaatacttattaaagaaacttaaagcggcttcagttgctcgtgttgaaatcgaaagatcaaaaaaccgtgttactatctttgttcatacatctcgtccaggtgttgtaattggtaaagatggtgaagctgttgatgcgttaagaaaagaagttagtaaaatggttaaagataaacaagtgtttatcaatatagtggaaattaaaaatccagatgttgttgctcaattagtagctaataacattgcggaacaattagaaaatcgtgcatcttttagaacagttcaaaaacgttctattcaaagagcaatgagagctggagctaaaggaattaaaactagtgtttcaggacgtttaggaggagctgatatggctcgtgctgaaggttactctgaagggaatgtccctcttcatactttaagagctgatattgattatgcaactgcagaagcagatactacttatggtaaattaggagttaaagtttggatttgtaagggagaaatccttcctgaaaagaagaaaggggataaataatcatgttgatgcctaaaagaacaaaatacagaagacctcatcgtgttaaatatgaaggtaaagctaaaggcggaactcaagtatcatttggtgaatttggattacaagcaacagaaggtgcttggatcacttctcgtcaaatcgaagctgcccgtgttgctatcaaccgtcgtttaaaccgtggtggtaaagtatggattagaattttccctcacttagctaaaactaaaaaaccattagaagtacgtatgggatctgggaaaggttctccagaagaatgggtagcagttgttaaaactggtcgtgttctttttgaagtagcaggtgttgatgaagaacttgctagagaagctcttagacttgcatctcataaattacctattaaatgtaaaatcattggaaagggtgaatagtcatgacagttcaagaaattagagaattagataacgctgctttattagaaaaagtagaagaatacaaaaaagagctatttggacttcgtttccaacaagctactggacaattagaaaacacagcacgtattagaacggttcgtaaatctatcgctagaattaaaacaattattagagaaagagaattgaaccaataggaggagatacaatggaaagaaacaatcgtaaagtttacactggtacagttgtatctactaaaatggataaaactattacagtgctagtagaaacacatgtaaaacataaattatatggtaaacgtatgaaatcttcaactaagtttcatgctcatgatgaagaaaacgttgcaaatgttggtgatacagtaaaaatcatgtcaacaagaccattatctgcaacaaaacgtttccgtttggtagaaatcgttaaaaaagcagaaactgtttaatatattaaaactctaaaaggaggtaaccaagaatgatccaaaacgaaagtagacttaaagtcgctgataacactggagctaaagaagtattagtaatccgtaatttaggtggatctaatcgtaaatttagtaacatcggtgatgttgttgtggctacagttaaacaagcagcaccaggtggttctgtaaaaaaaggtgaagtagtaaaagcggttatcgtaagaactagatatggagtcggaagagagaatggttcatatatcaaattcgatgacaacgcttgtgtaattataaaggaagataagtctccaaaagggactcgtatcttcggaccagttgcaagagagttaagagatgcagattttatgaaaatcgtatcattagctccagaagtattataggaggaacttaaacatgaaaatccgtgtaggtgatactgtagaagttatcgcaggtaaagataaaggaaaacaaggtgaagtgttacaagttcttgcaaaacaagacaaagtaatcgttgaaggagttaatatggtaactaaacatattaaaccttcacaagcagatcctgaaggtggaattgtaacaagagaagcgcctattcatgtttctaatgttgcattctatgattcaaaagctaaggctcctgttaaacttggatataaatttgttgaaaaagatggtaaacaagtaaaagttcgagttaacagaaaaactggagctgaagttgataaaaagaaaaagaagtaggaggataaagaatgagccgtttaatggaacgttatcaaaacgaagtggttaaatctttaatggaaaaattcaattattcttcaaaaatgcaagctcctaagattgaaaaaatcgttttaaatatcggtgtaggtgatgcagtatctaattcaaaattattagatgaagctgttaatgaattaacattaattagtgggcaaaaacctgttatcactagagctaaaaaatcaatcgctggattcaaattacgtgaaggagcaccaattgggtgtaaagtaactttacgtggtgaaagaatgtatgaatttttagataaattagttaatatctctttacctcgagttagagatttcagaggtgtttcaaacaattcatttgatggaagaggaaattatactttaggtattaaagaacaattaattttccctgaaatcaactttgataaagtaaataaattaagaggaatggatatcgtattcgtaactacagctaagactgatgaagaaggtcatgaattattagctcaattaggaatgccattcaaaaaataagaaggaggactcacaaaaatatggcaaaaacatcaatgaaagtgaaacaacaacgtcctcagaaatacaaagtgcgtgaatacacacgttgtgaacgttgtggaagaccacattcagtaattagaaaattcaaactttgtagaatttgcttccgcgaattagcttacaaaggtgaaattccaggtgttaaaaaagcaagctggtaataattttatccagatggaaggaggatttagcaaatggttatgacagatccaattgcagatatgttaacaagaatccgtaatgcaaacagacaacatcacgaaacagtaatggtgcctgcttcaaaattaaaagtagatattgctgaaattttgaaaaatgaaggattcattaaaggatataaagttgagggcgaaggtccaattaaaaatatcgttatcactttaaaatatagaggtaatgatcgagtaatcactgatttaaagagaatctctaaaccaggattacgtgtgtatgctaaagtaaatgaaattcctaaagtattaaatggattaggaattgtaatcttatcaacttctcaaggtgtaataactgacaaagaagctcgtgctaaacaagtcggtggagaagttcttgcatatatttggtaataaaaaatataattcaggaggtgcaaactgatgtctcgtgtcggtaataaaattattaatgtacctgaaggagttacagtagaagtcgctgaggataatacagtaactgttacaggtccaaaagggactttagtaagacaattttcaccagtaatttcaattaatcaagaagataatgtaattactgttgctagaagtagtgaacaaaaaactcataaacaattacatggtacaacaagagcattacttgcaaacatgatcgaaggagtacacgttggattcaagaaagaattagaaatcgtcggaatcggatatcgtggacaaatgaaagggaataccttagttttaaatatcggttattctcatccagtagaagttgaaggtgaagaaggagttaaaattgaaactccatcaaatactaagatcgttgtatctggtatttcaaaagaacgtgttggacaagttgctgctcaaattagagaagtaagaaaacctgaaccatacaaaggtaaaggaattaaatatgttgatgaaagaatcatcagaaaagaaggaaaaactgctggtaagaagtagttttgaaaggagcaaattaaaatgtcaaaattacaatctcgtaatgatgttcgtttaaaaagacatgctagagttcgtgctaaaatcagtgggactccagaatgcccaagattaaatgtgttccgttcaaatgctcatattcatgcgcaagttattgatgatgttaatggtgtaactttagctagtgcatcaagtgttaatatgaaattagaaaacgggtctaacattgctgcagcaactgctgttggtaaagctgttggagaagcagcacttgcaaagaatattaaaaaagtagtatttgatcgtggtggatatgtttatcatggtcgtgtaaaagccctagctgaagctgctagagaagctggattagaattctagagggaggtcaatatggaacaacgtaaaccaagaaacaatggaccaagaaacaatggacctaaaaaaggtcaaagaaacaatggacctagaagagaagaaaaagaatttgaagaacgtgttgttactattaaccgtgtaactaaagtagttaaaggtggacgtaaattccgctttgcagcattagttgtaattggtgatagaaaaggtagagttggttttggtacaggtaaagctaacgaagtacctgatgcaatcagaaaagcttctgaaaatgcaaaaagaaatattatcaacgttccttcagttcatggaacaattcctcatgatgttactggtatttatggatcaggtaaagtatttattaaacctgcttctcaaggtactggaatcattgccggaggaccagttcgtgccgttgtagaattagcaggatatactgatattttatctaaatcattaggttctagaacacctattaacatggttagagctacaatggaaggattagcatcattaaaaacagttaaccaagttgctgaattaagagacaaaaaagtagaagaaatttttggataggagggcgtaaagatggcaaaaacagttatgattacgcttgtaaaaagtccaattggtcgtttaccaaaacaacgggctactcttaaagcgttaggtttaacaaaattaaataaaactgtagaaaaagaaaacaacgaatttattcaaggaatgatcaaagttgttgaacacctagtaaaagtagaagaaaaatagggaggtgtaactaatgaaactacacgaattacaatacactgaaggtgcacgtaaagctagaaaacgtgttggacgtggtacaagttctggtactggtaagactgctggtagaggacaaaagggtcaaggtgctagatcaggtggtggaaagaaacctggatttgaagggggacaaacaccattattcatgcgtttaccaaaacgtggttttacaaatttcaacagaatagaatacgctattgttaatttagaacaattaaattcatttgaagcaggggcaactgtttgtcctcagactttaaaagaagctggaattattaaaaaagaattagacggtgtgaaggttcttggtaatggtaaattagaaaaagctattacagttaaggctcataaattttctaaatctgctgttgccgcaatcgaagctgcaggtggaaaaactgaggtgatttaagatgtttacatttttgaaaagcgttttcaaaaaaggtgaacttcgccaaaaaataattttcactctaggaattctatttgtttaccgtttaggggctgcaattactattccgagtgtcaacactggagcattaagttctagtgatgccactaatgggatttttgggattatgaacttacttggtgggggaactttagaaagattctcattgttctcactaggagtttcaccttatatcacttcttctatcattattgaacttttatcaatggatgtaattcctgttttaagtcaatggcgtaaagaaggtaacacaggtaaaaagaaaaaagaccgtgttacaagatatgtaactttatttttagcagcattacaaggaggcgtgttaacatacgcttttgataatggatataatattttatcagattcaagtatttggacatacatctatgttgttttagttatgatggctggaagtatgttagctgtatggttaggggatcaaattacaaataagggaattggtaatggggtttcattattaattttcacaggaattgtttctaacttaccaactagctttataactacttttaataatttagttgacactagtggtaaagctgttgatatgtggttaggaatagcttggtatgcattatttgtgatagtttatctttcaattgtaatctttgttgttttcaatgaaggcgctgtaagaaagataccaattatttatgcaactagctctaatacaacaatgagaactaaagatcaaacacatatgcctattaagattaatagctcaggggttattcctgttatctttgcttcttcagtattagcagctccaagaactattgttagttttatggaaactagcagtgttactacttggatcaatacaatttttaattatcaagaaccagttggatttattctatatatcttgatgattattggatttacatttttctattctaatttacagatcgatgccgataaaatcagtgatgatttgaagaaaaatggtggatctattcctggagttagaacgggaacagatactaaaaattacattaaaaaggtcttaaacagaattacagtagtaggatctttatcactatgcattattgccgctattcctatcatcacaccagttatttggtcacaaactgctaatgcgtcattatcacttggtggtactggattaatcatcgttactggtgtagcattggaaactgtaaaacagattaaaacacatattacaagaaaagaatatcacggttatattcgtagatagtataagaaagagggcgcatatacatgaatattattctaatgggaccacctggagccggtaagggtactcaggcagcaaacttagttaaagagtatggacttactcatatctctacaggggacatttttagaaaagcactaaaagaacaaacaaaatatggtgtaattgctaaatattttatgcagtttggtcatttagttcctgatgattatactatccaaatggtaagagaatatttacaagaaaatgaattcccaaaaggatttattcttgatggatttcctcgtactataattcaggctcgtgaactagaaagtattgctaaggaatttggttttgagatcgatgctgtaattaatttagacattgaattagatcgcttagtaccacgactttctggtagaagaacttgtaaagaatgtggagcaagttatcacattgagtataatccacctaaagttgaaggaatttgtgatatttgtggtggagaattgtatcaaagacctgatgaaagcgaagaagctgtaaaagttagacttgatacttatgaaaaacaaactagacctttaattgattattatacaatgaaaggacaaatcactaatattaatggtgatcaatctatggaagacgtctttaaggatatcaaagctagcctggaggttaaataatgattgttaccaaagaccgtagagaaattgaattgatgagagaagctggaagaattgttgcattagtgcatgaaaaacttaaagaagtgattgtacctggaattacaactaaacaaattgatgagatttgtgagaaagtaattcgtgacaataatgcaactccttcattccttcatttatatggatttccaaatagtgtttgtacttcaataaatgaagttgttgttcatggaattccaagtgatcgaaaattggaagaaggagatattatttcagttgatgttggggcttgctataaaggatatcacggtgatagtgcctggacttatgcagtcggaaaaataagtgatgaggctaaacgtttaatggaagtttgtgaagcttcgttatatgcaggtttacaacaagttaaaccagggaatcgcttatcagatatttctcacgctgtacaggtatatcttgaagatcatggttgtactacaccacttgattatactggacatggaataggtagtgaagtacatgaggatccagctgttccaaattatggtaaagcgggtcgtggaccaagacttaaagcaggaatgacacttgcaattgaaccgatggctcatttaggaggctgtgagactgaggtattggaagatggctggacagttgtaacaaaagaccgctctttagcggctcattatgaacatacaatcgtcattacagatgatggttatgaaattttaactaaactttaattaaaagggagttgagacctatggcaaagaaggatgacgttcttgaagtagaagcaacggtacttgagacattaccaaatgcaatgtttaaagtagcgttagaaaatggagtagaaatccttgctcacgtttctggtaaaatccgtatgcattacattcgcattttaccgggggacagggttacggtagaaatttctccatatgatttaacacgtgggcgaataacatttagacataaataaaacttaaatcttccaggaggaggtagacaagatgaaagtaagaccatctgtaaaaccaatctgtgataaatgcagagtaattaaaagaaaagggcgcgtaatggttatttgcgaaaaccctaaacataaacaaagacaaggttaattagtagttaattaggaggaaataaaatggctcgtattgctggagttgatatcccacgtgacaaacgtgtggttatctcattaacttatatctatggtattggtaaaccaacagcacaagaaatcttgaaaaaagttggaattaatgaagataccagagtaaaagatttaactgaatatgaaattggtaaaattagaaaagaagtagaatcaatcaaagttgaaggtgatcttcgtcgtgaagtagctttaaacattaaacgtttaatggaaattggaagctacagaggaattcgtcaccgtaaaggacttcctgttcgtggtcaaaaaacaaaaacaaatgctcgtactcgtaaaggtaaagcaaaaccaatcgcaggaaagaaaaagtaagataggaggatgaactagaatggcaaaggtaagacaagtacgcggaaaaaaacgtgtaaagaaaaatattgcaaaaggtgtagcacatgttcattcaactttcaataatactattgtgacaattactgatgaacatggaaatgtattaacatggtctagtgcaggggcattaggattcaaaggttctagaaaatctacgccatttgctgcacaaatggcttctgaagctgctgcaaaagcatcaatggatcatggagtaaaatctgtagaagtatgtgtaaaaggtccaggaccaggtcgtgaagctgcagttagagctttacaagctgctggattagaagtaacatcaattaatgatgtaacaccaattccacataacgggtgccgtccaccaaaacgtcctcgtggataattattgtatgatcaaaaaaatgataattcctagtgaggagggaaacaatgcaaaagtttgaaaaagcaaattttaatatagctaattatgatgaaacagataattatggtaaatttgttattgaacctctagaaagagggtttggtacaactttggggaattcacttcgtcgagttcttctatcttctttacctggatctgctgtttatgcaattaaagttcaaggagcaattcatgaattttctgcagtagatggtgttgtagaagatgttacatcaattatcttaaatcttaaaaagttagtttttgatgtagatagtgatgaatcggctacaatgattattgatgttgagggacctgctacagtaacaggtgctgatattcaatgcccttctgaagtaacaatgatctctaacgatatggtaattgctcatgttgctcaaggtgctcacttatacatggaattatatgcaaaaaaagatcgtggttatgtaagtgctgatcaaaacaagaaagatattaatacaattggtattattccaactgattcaatcttttcgccagttgaaaaagtatcttatgcagttgaaccaactcgtgttggggaaagtgcaaaatacgatcaattaacattagaaattgaaacaaatggagcattaaaaccttatgaagctatttctctagctgctaagattttggtggaacacttaaatatgtttgttgagttgactgatatggctgtaaatatggaagttatgtctgaggctcaaagtgatactactaataaagtattggatatgacaattgaagaattagatttatcagtacgttcatacaattgtttaaaaagagcaggaatccaaactgttcaagatcttgccgctaaatctgaagatgatatgatcaaagtaagaaatttaggtaagaaatctttaaaagaagtaaaagaaaaattagttgaattagggttagggtttaaacctatcgattaattcgcaaatacgaaggaaggagcgctaatctcatggctaaaaatagaaaattaggacgtacttctgatattagaaagtcaatgttacgttctcttgcgacagaagtaataatgtatggtaaattagaaactacagaaacaagagcaaaagaagttcgttctgttgtagatgaattgattactttaggtaaacgtggtgacttacatgctagacgtcaagctgctgcagtattacacaatgtaattgatgaatcaactggtaaaacagctgtgcaaaaattatttgatgaagtagcaccaaaatataagaatgtaaatggaggatacactcgtatcttaaaaacttacaatcgtaaaggtgacaatgccccaatggcaatcatttcattagtataattaaaaagaccttttggtcttttttcttttacttgactaaagtgtttaataaatatagaatgattaacagtagtatagtaaggcggtgaataaatggaaaagataattgaggtaaaagatttatcatttgagtatgaaccaggattaaaaacaattaataatatttctttcgaaattaataagggagattatgtagctattttaggacataatggtagtggaaaaagtacgattgcaaaattgttaattggattattagagaaaaaaagcggctcaatcatcgttaatgggtatgagcttaacttagaaaatttatataaagttcgtgataatattggaattgtttttcaaaatccagacaatcaatttataggtgctacagttcgtgatgatattgcctttggtttagaaaatacatgtgtacctcaagaacatatggatgaaatcattaatacttatgctgctaaggttggaatgagtgattttcttgatcatgaaccaacaaaattatcagggggtcaaaaacagcgggtggctattgcaggaatcttagcaatgcatccagcaataattattttagatgaagctacaagtatgcttgatccgatgggccgacgtgaaattaatagtttggttaaagaattaaataagacgaaagatattacaataatttcaattactcatgatatcgaggaagcaaaaaatgcagataaagtaataatgctaaataatggtaaagtagttattagcggtagaccagaagatatttttagcgatgaaatgaaactagtaaaatacgaattagatataccatttgccttaaaagttgcccaagggttagaaaaattaaatataaagactagcaaatctttagatatggaggtattgatagaagaattatgccaattacatttaaagaagtagagcatgtatatggacaaaatacaccttttgcttatcatgctttacgcggagtaaatttaaatattaaagataagagctttacagcaattattggtcaaactggaagtggtaagagtactttgattcaacatataaatgcattattactgccaactagtggaagtattaatattgatgaatatttgattacagtaacagataaacctaataaactcaagccattaagacaaaaagcaggattagtttttcaatttcctgaatatcagctatttgaagaaacaattgaaaaggatattatatttggaccaatgaattttggtgtaaatgaagatgaagcaaaattaattgcatgtaaagtacttaaaacagtaggattagatgaaagttatttagataaatcacccttcgatttatcaggaggtcaaaaacgccgtgtagctattgctggtattcttgcgatggatcctgatattttaattttggatgagccaacagcgggattagatccacaaggtacaaatgaaatgatgagtttatttaaaaagataaatgatagtggaaaaacaattattttagtgacgcatgatatgaatcatgttttacagtattgtgatgaagttgttgtaatgaatcatggtaaagtagaaaagcatgatacagtaactaatatttttaaagatagtggctatttaaataacttaggtattaatttgccaattattacagaatttattttaaaactaaataacagagggtttaatatagattcatcaattaataatatagaagatttaattagtgcaattggtggtgagttaaatggatagtatgacgtttggtaaatatattccagttaattcaattattcatcgtttagatccgcgcttaaaaattggagcattactaattttcttagtagcagtattttttgatgctggctttattggttatggtataatggcattatttgttttagttactgcttttctatcaaatatctcaataaaacatattttaaaggcaatcaagccaatgctatttatgatgctgtttttaatgatttttaatatttttctaattaatacaggagacgtaatatttacaatcggatctttaaaaatttattctggggcattgctacaatcagcttatatttttattcgattagttttaataattactatgacgacaattttaacatcatcaacaaaaccattagatcttacattagcgatcgaaaatcttttaaatcctttaaagagatttggtttccctgctcatgaattagccatgatgatttctattgcattacgttttatcccagatttattagatgaagcaaaaagaattatgaaagcacaagcaagccgtggagttgattttaatgaaggaaagttagcagaaaagattaaatcaattgtttctttaataattccgttatttatttctgcttttcagcgtgctgaagatcttgcaaatgcaatggaaagtcgtaactataacccagaagctaaaagaacccgttataaatctttatcttggaaaggacacgatactatagcacttatttttactgtattagtatcgatgagtgtaattgctctaagtgttattctgtaatggttagagtaaaatgtgtggttagttatgatggcagtaaatttcatggctttcaagttcaaaataaattactaactgttcaaggagaaattcaaaaagcattaaaaaatatttgtaaagaggaagttattattcatggttcaggacgtactgatgctaaagtacatggagttaagcaggtatttcattttgatacgacaagacaaattgctgaggaacagtggaaaagagcaataaatcattttttgccaaatgatatttatatcatagattcaaaatttgttagtgatgattttcacagtcgttatagtgctaagaaaaaagaatatcattatttattaagtacgaacgaatataatccttttgaaacaaattacatatttcaatatggaagacctttagatataacattaatgaaagaagcagctaagatttttattggagaacatgattttgcttccttttgcagttatgatcaatatggtaatacaataagagaattatatgaattatcgattattgaagatcaaggaattattaaatttattttaattggtaatggttttagacgttacatggttagacatatagtaggcggattgattcaggttggagctaaaagaattacaaaagataggctacaagaattattagatagtaaaggacaaaaaaagtgtttatttaaagctaaaccacaaggattatatttatatgaggtattttatgataaaaactaattatcatactcatactttccgttgtggtcatgccaatggtgatgaagaagcaatgataaaaagtgccattgataataagatagagattctaggttttagtgagcatataccattacctaactatcgttatcatatattaaaaggacttcctcatacattaaaagatattaatgcttttagtgtggctataaaaacaattatcactaatggaccatcaatgcggatgccatatagtaataaaaaatttcatcttgaagagataaagaggctaaagagaaaatacaaagatcaaattactatctatcaaggatttgaagctgaatattttgaagagtatttagactattatcaagatttattgagttcaaaagaaatagattatttgattttggggaatcattttaatagatacgctgttcatacttgttattatggaaaatcaaacataactaatgaagaaatcattagttataaaaatgatttattaaaagcaatggatacaaatttattttcatatattgcacatcccgatttatttatgatcggtaaaggaagatttgatgatttttgtaaaaatattacccaggaaatttgtcaaaaagcattggaaaaagatattcctttagagataaatgctggaggaatacgtaaagggttatgcaaaatagatgatgaaatgctttattcatatcccaatgatcatttttttgaaatagtcggggagatgggatgtaaagtaattttaggtatagatgctcatgatccaaatgattataatgatgagatatttgagacattaaatagatttgttaatagacatcatctaaatattattgatagttttaaatttagaaagggaaaataggttacagataacaggaattattatacataatagtttcaataaaatattagttacttattttctttattatttttttataaatggtaaaatatggatagaaagggaggtggagttatgatacgtgattgtattcataaatatttagaggagcataaaagtaattatcaaggaaaataccgttgtcatagctgtgtacagacaaaaaaatttgaacgtaaatttcactattatattagagatattcaatttagagaaatcagtgtttttctaactttagattattatggtccagagattaaatctactttttcagttgacctccacgagcaagaagaagaatatataataaaagatgctctaaaacagattttatattttgataaatatcatacgatcctacattgtcatgtttttcaatattttatagatagtaaaaacaccggtatcatgttagaacctttagactatcgaaatattttggattatttagaatatcatagtggtatcaatcaagaaactattgactcattctatgaattttttatgccatatttatgtaggttaatagaaaatggaaactgtaaaaaatttatggactctgttaatttactacttgataaaatcttatatgaatatgaatgggatggaactactgctaaatacttagatacccaatatcagtatcatttatattattttagaaaaattattaggatggtatttgaaaaacttgatgttttttatgatcaggtcaaagaaagcttattagaagcaatttggcgattatgtaattcccaaagatttgcttttgcaattatgacagattttggaaatttagttttgtcacattatcgagttactaaagctattttcaaatatattgatgagtgttttcaaaatgaaggagatcctaatattgttgtaaggtatttaaaagcaatttttgaaagtaatcatgaggcctatcgtgaagcagcaatggatgtaattagatttgttatgcgagatatgcttacattcgcaaatcatgacttacagttagcgattggaaattccatggtacaaaacgagggatatgatttattaataaacttattttcaaaagattataatacatttgtttttgtatgttttccaatatccacttttccagacgaatatcatgaaaaaatacgtggagaattggaaaaagcaattagattctatgcaggtagaatggaacatgatgaatatcgtttaagttcctttgagcaagtatgtaatataaaccggttattaatggaaaattataaggagtatggtaaaaatgaataagaatggaaaaaaagtatttacttcattagctgttttagcaggattagcatcaggtgctggcgctttgaatgcctttgtcaatcgaactgttaaaactatgttatatcgtcatcataaagaagatgataagccaagtattttagaaactaaatataatgcaaaaaatattcatatcaaaaataatcaaggaataaaactaagaggattactaatagatgaaaaggaagctgctaaaactttagtgattttacatccatttggcttagaagcaaaagatatggcattatatgttccgttttttaaagaacgttatccaagctggaatattttgttaattgatgcatgtggacatggtcaaagtgatggatatattcgaggattaggaataaaagatgttaatgatttaatttgctggaacagatatttagttaaagaatatggaaataaacatcaaatcattttatatggtaaagaggctggagctaatacaatattaaaagctgcaagtaagcacttgttaaaaaatgttaaagctattattagtgatggtgcttatactagcgtatatgatatattgggatatcgaatggttaaagattataaagtacctaaatttccaacaatgcggatgattaaaagaaaaattaaacaagaaatcaaaattaatattaaagagtcatatccattaatgttgaagcataacgatattccaactatatttatccatatgaaagatgatgattttgtacctttagatatggtgtatcctctatataatacgaatcgtggaagtaaagtattatttgttttaaaagatgaacactatttatatgaacttgaagaaacagacgagtttaaaaatacattaaaatattttatctcaaaatatgttgaaatgtaaaaatgtcattgaaactcataaaaatatattaattagaaaagtataggaagattaataatagagtattatataatacttatagtattcagactttgagcagaaatcaaagtctgttttttaaataaaatatcattgtgctacattatagttacaataagatcttagcgcaacaaaagtttcttgagttaaaatgtttgtaataaacacaattttaatagttaaataatataatttaatactaattgttataaaattatcataaatatatcaattttttgatatatttaagcgtgaaatattgacattaatattttgtaatgcaataatataaatatataagggttgttactattcaattaggcaagactaagagtgtttttgtgcattctaatgtcttgccttttttatcgaatagaaagtttttaaacaaaacttataacagtatagaagaaaagtaaaaggtaatattcaatcgtagtaaaaaattatattttaaaaaatgaatagaacttttcttcaataaagattaaaatactagattattataaaaatatttactggtagaatttacacaaactttgagacataattcaaaataacaatttgagttattaaagttaaaaacttcatattaaatattataataacagattatttttattaactacgattgaaaaaattaattcgttcaataaaaacggatagaaatggaggaaggtatgaaaaaatttttaaaagtattagcatgcttgatgataatgatatcatcagttgccacaagcattgatttagtatcggcccaagagtacaaatcaggaatatttgtagatgcaaaaaatggcgatgacaacaatccaggaacgtttgacaatccaattcaaacacttataaaagctcaagaattagcaagagaaaagtcgaatgaaatggatgaagatttaaaggtttatttaagaggtggtacatatttacttgatgaaacaattacttttactagtgcagatagtgggaaaaatggtcataatataatatggagcgcttttaataatgaagaagttattatatcaggcggaacatcaattgttaattggactaaagtagatgatgaaaagaatatctggcaagcttctgcaaatggtttagaaagtagagacttatatgtaaatggaaaacgtgctactcgtgctcgtagtgaacttaaagcctatgaatttacaaaaaaatatatctatgtagatgctgaaggcttacctgctagtttctcgcgccctgatgatttggaagtagtatttgcacgtaaatggaaatggtgtatcgaacgtgtaagttcaatcggagcaaatgatgattatgaaaattgtcaaagaataaagattaccgatgaatcatacaatagtttaaaaactaatcttacaggagcagcgatcgatgctgaaggaatgcgagatggtgtgagatatttacaaaatgcctatgaacttttagatgaacccggagaatggtatttaaatacagaagaagatcaaatttactatatacctcaagagggacaagatatgaataatattgatacagtacttgggcggttagaaaatctagttgtatttgatggacagctaggaaatcctgttaaaaatattacttttactggtttgacattccaatatacaacctggttgaaaccaaattggcctgatggtttacaaacattccaggcaagtgcaattatcaatccagaagatgtttgggatagagaatggattccttcaactggtagtgcaatctatggtaaatatgtcgataatatcaatattgttgaaaataatttcaaagagcttggaaatgctggtgttcacttaggcagagcaacaaaaaattcatcaattacaaataataaatttgaaaatttagcaagtggtggtttgttgttaggagatgttacctaccaggatcatataccagtgctagaagatttaacagaaaacaacaaaattacggataactatattacgaatgtcggtgaaacgtatcgggcatgtgcaggtatccttgtcggttttacaaaaggaacaacagttgagtataacacagttaaaaatcttccatatacaggaattagtgttggctggggctggggttataatgattttgatgaaggtaaagaatttatgcttggaaataatagcatttcttataattatgttgaaaatgtattgacggaaccttctttaatagatggtggtggaatttatacactaggtagacaagatgattcgatcattacaggtaattatattgatggtgtatgtaatgagtatggaggaatttatcttgatgaaggatcatgtggttttactatcacaaataacgttcttaccaattgtgtccgtaactggctttataaaggtgattataattatatttatgataattatgcaactaaagcacaagaaccagatagagatgaacgtttaccaattggtttagaatcacaatatagatttgaaaacaatgatatgtgggatgagactgcagtagccactattaaagcagccgcaggagtaagaattaaatcagaaccagaaaaacctattgagcctgatgatccaatcgtagatgttccagaaacgaatgatccaaatttagaaaacggtactaatggaaatgttcaagaacaaccgattaataaagatgaaaaaaatattgtaaaaacatctgatgatacattgatagaagtctatggaataatgactgttattacggttttagggttacttgtattaaaaaaaggaaaacatatgagtagataacatggggtttaccccatgtttatctatatatgataaaaataagttttttatattttagttttcctttaattttaaaatagtttagatttagagataaagaaaataattaaatatttttaatatttattaaaaaggaaataaaaagttcatttttaatttttaatttgtgtataatatatcttataaagagaggagggagtgttatgagttgtaaggaaaatgcagaacttgatatcctatataatttattaacttatataaatgcatcctatagtcaagatatgtattatacaatttgttatcaagtattaaataatattgaaaaaatacctagtattagtataaatgaattggcagatttatgttatacttcaccagcaactatttctcgcttttgcaaagcactaaaatgtgacaattttgcagattttaaaaaagaagttcaaattggattacagcaggctagtcatgagataaaattagagccagaagatttggtagcaattcataaagatccttcaagatgtgtagatatggtctatgatctatctattacatctttattggaaagtaaaaaatatgttaatatacatgagattgatcgattatgtgatattatatatgatgctaaaaagctacacttctttgggtttcagtttaataaaattttagcttcagatatacaatttaaattagtgaaattaggtaaattttcatatgcatttgctgatcgcggggatgatagacaacgaatcgaattattagatgaaaatagtgttgcaattgtactttcagtgagagctcgtccaataccgataggtgagctagttaagtcaataaaaaaacgaggtgctaaagtaattttagtaacattgaatgaaaatagtgaagtaattgatttagctgatcatacatttattatacatggaaaagagagtgattttacagaatcatcgctatcaggaacaacagtaatgaaaacttattttgatgttttatatgtgcgttatggattattgtatccaagaagataaggaggttgctatgtatagttttacaaatgattatagtgaaggggcacatcctaaaataatggaagccttgttgaaaacaaattatgaacaatgtgatggatatgggttagataaatattgtttagaagctactagtattttgaagaaacttgtagaaaatgataatattgatgtacattatctcgttggaggaactcagactaatgcaacttttatatcatctgtattaaaaccatatcaagctgtaatagctgctgattgcggacatatcaatgtacatgaaacaggagctattgaagcaacaggacataaaatattaacaagagtacataaaaatgggaaattactaccagaaatgattaaggaaatcattgatgagcatattgatgaacatatggtacaacctaaaatggtatatatttcacaaactacagagtacggaagtgtgtatacgctagatgagataaaagaaatctcacagttatgtaaagataaaaatttatacttatttgttgatggggcaaggctgggcagtgcattagcgcttgaaagaactccaacattaaaagatttagttaaatatagtgacgccttttatattggtggtactaaaatgggagctttatgtggagagtgtctagttattataaatgataaacttaaaactgattttagatattcaatgaaacaacagggagcgatgttagctaaaggacgattgttaggaatacagtttaaagaactatttagtaatgatctttatttagaaataggaaagcatgaaaatgcaatggcggatattttaagagatggtcttaaagattttgaaatgtacgttgattctttaagcaatcaaatttttcctattttaccaaaagcattgatcgaatatttgaaacaggattattctttcattataatgaagcagatagatatggatcattattgtattcgattagtaacttcatgggcaacacagaaaaaaacagtagagagttttgtgaaaaaagttaaagaatttattaataaatagaggtatattatagcttgtaatcaataataataagtaatataatgggtgtaggataatttcctataaaagaaagattggagaaataaaatgaataaaactgaattggtggaagcaattgcttcaaacacagaaatgacaaaaactgatgttgataaggtagtaactgcttttgtagatgtagtaacagaagcgttagtaaaaggtgaaaaagtatctttaaaaggatttggaaattttgaagtacgtgaaagaggagaaagaacaggacgtaatccaagaacaggtgaaactatgactattgcagccagcaaagcaccagcttttaaatctagtacggctttaaaaaatgcagtaaataaataaaattatagaaatggtctaaagaccattttttttgtctaataggaatttcgattcgtttaggtataaaataaaaatatccaatcataagggtacatttattggctggatatttttatgtggctaaaaaagtgttagaaatatcattttttcctaaccattcttccattgcattttggacactgacagctgtatccttgattctctttacctgaatatatttcttcacctaaaaactcttctagtatccattccggtacttcttcttcataaccacatctcttacatttcatcggtatcattacctctggttcccctaataattctgctagttcttcatcggtcagattgatcacttgtttaccttcttcctatgctcatagctgtattttgctttgagaatctttcggtcacgatattctctgtcatttttatcgtttccaccaaatggttcatagctttctttatattccattgtttctccacattcacaaagcaatggatcccgttgaaatgattttatcatattatatctgaaatgtaactctttttgtctcttttctatcatcacccttctgtcattttttagttcttctactcttttttgtttatggctcaacagttcagccatcctgttataggtctttattgatttatttgaataaaaaccaaaatatcttaccatcttgaagttcttttcaggacagtgcatcaataccttgttaagaaaactgtaaacagattctgtgacatctacacgcttattatcttcatgacgatgatagaaccaatgaatcattttcttatcatcatcatagtttactatcctgctttcagccattattggtctgctggtataacgggttatatattgaacacatttttcaatgtcgtccttagtctgttcatctttgatttttggagcatagacatagaacccttcctcgtattttcggtagaaccagcttttaaggctttgaaattctttgtcgttgccaatgtgtctgtcaagatagctgagtaattgataacgccatgtctggcgaagttttttatagtccatataactgaagtttttgattttgtcatctttagaatcataagcatcttcgcataccagaacatggatatgcggattccagtcaagaggtctgccaaaagtgtgcaatgaggcaatggcaccaaagatcacattatcagttgtatctttgtaaagatattgagatttattgctttttttatgatagaagatacctttctttttttcaagacgcttttgtctgcgatattttctgtcgttgaaaagggaagccagagtatttctggcaacgacaaaaagaccatcaagcagtgatcggtttttgataaagtagaagcgaagctgagcagggatggtaaagacgatatgacgatgtttggatttaaaagccatagagctgacataagcagcgcgtctttgactggatttagaaccacatttggtacagtatctggaactgcaggtatgagcaacaatagtttcattgccgcagttaggacagacaaagagatcataaccaagatggatagaagaacaaaggatagttttttgaacattatcaaaagaaacatccctgagtttgcctttatcatgtagattaatgatatagtcgtaattgtcaaagaagatatatttaaaagtatttttaccgtcttttttaacaaactgcttaaaattaaaaagacctaatgtatcagaaggaacagataaatcgatcataaagtcatctcctaaaatcattataataccaaaaaggatgaaaggcatttaaaatgcactatcacccaggtggacaaaatttattttgtcccttttttattctaataggaatttcgattcgtttaggtataaaataaaaatatccaatcataagggtacatttattggctggatatttttatgtggctaaaaaagtgttagaaatatcattttttcctaaccattcttccattgcattttggacactgacagctgtatccttgattctctttacctgaatatatttcttcacctaaaaactcttctagtatccattccggtacttcttcttcataaccacatctcttacatttcatcggtatcattacctctggttcccctaataattctgctagttcttcatcggtcagattgatcacttgtttaccttcttcctatgctcatagctgtattttgctttgagaatctttcggtcacgatattctctgtcatttttatcgtttccaccaaatggttcatagctttctttatattccattgtttctccacattcacaaagcaatggatcccgttgaaatgattttatcatattatatctgaaatgtaactctttttgtctcttttctatcatcacccttctgtcattttttagttcttctactcttttttgtttatggctcaacagttcagccatcctgttataggtctttattgatttatttgaataaaaaccaaaatatcttaccatcttgaagttcttttcaggacagtgcatcaataccttgttaagaaaactgtaaacagattctgtgacatctacacgcttattatcttcatgacgatgatagaaccaatgaatcattttcttatcatcatcatagtttactatcctgctttcagccattattggtctgctggtataacgggttatatattgaacacatttttcaatgtcgtccttagtctgttcatctttgatttttggagcatagacatagaacccttcctcgtattttcggtagaaccagcttttaaggctttgaaattctttgtcgttgccaatgtgtctgtcaagatagctgagtaattgataacgccatgtctggcgaagttttttatagtccatataactgaagtttttgattttgttatctttagaatcataagcatcttcgcataccagaacatggatatgcggattccagtcaagaggtctgccaaaagtgtgcaatgaggcaatggcaccaaagatcacattatcagttgtatctttgtaaagatattgagatttattgctttttttatgatagaagatacctttctttttttcaagacgcttttgtctgcgatattttctgtcgttgaaaagggaagccagagtatttctggcaacgacaaaaagaccatcaagcagtgatcggtttttgataaagtagaagcgaagctgagcagggatggtaaagacgatatgacgatgtttggatttaaaagccatagagctgacataagcagcgcgtctttgactggatttagaaccacatttggtacagtatctggaactgcaggtatgagcaacaatagtttcattgccgcagttaggacagacaaagagatcataaccaagatggatagaagaacaaaggatagttttttgaacattatcaaaagaaacatccctgagtttgcctttatcatgtagattaatgatatagtcgtaattgtcaaagaagatatatttaaaagtatttttaccgtcttttttaacaaactgcttaaaattaaaaagacctaatgtatcagaaggaacagataaatcgatcataaagtcatctcctaaaatcattataataccaaaaaggatgaaaggcatttaaaatgcactatcacccaggtggacaaaatttattttgtcccttttttatcttaaatttgttatataaagctcaaaaatttgataatattaagttgataaaatataattaatattaaggagggatattgcaaaaaaagtaaatagaatttattaggaataaaaattttatgcttatctaaaatcaaataacatgtttacacatttaaatattaactggtgaaaaatttaaattatactggggaacttatgttttatatcattgtaaaagaaaataatcaatttttatgatgatatgcagtttttaaatcgaaaatggagaggagttagattaagtgtacaaatatgaaaaaattgagtatgataacaatttgcctactaaattacatgatttttttgtagaaaatagtagtggagttcccgttgataaacattggcatcgtggaattgagatcatagtaccattatatggaacatttaatttgtggataaatggtgatatggtaagaataattgcgggaaagatttatattattaattctcaagatattcatgctgttcatgttattgaaggtgaagaaatatataaaggttatgcattacagataggttatgattatttaaaagagtgttatcatgatattgataaaatttattttcagcagcctaacgaagaaataaatcgagtgttattaaaaaaaatactggatataattagattttatgaggatgaggatgaggatgaggatgtatttaataatattagaataaagggacatattcaaatgcttgtttttcttttgctggataacttggctaaagaaaaaagtgattatatagaattgaaagataataaatataaaaatagaattataaatattattaaatatatggaaactaattatcaagaagatctttcagtagataatattgctgaaagatttgaaatatcaaatggatatttatcaaagttatttaaagataatttggatgtaactgtgaaagagtatttaactcgattaagattatggcatgcggaagaagaattgatttcaacggactatccagttattgatgttgctctaaataatgggtttcctaatgtaaaatcatttaatcaaacatttaaaaggaaatattttttaacgccagcaaaatatcgagaaaagatgagaaaatgacatattttaaaggataaaaagccattcttgtaagcgcttaaaattatataataaagttataagagagagaaagggatggtaaaatgatgaaaaaggttttaagttgcttgatctgtgccttgatggtcatgggtcttgtaagggtgtcagtttcggcatcggaaggagtagcagaaggaactcaaaaagcctatgttattggtgatgactggggaccagctgtttctaaaactgtaattgaattagataagacaattaatagtgattcagtaaataaagacagctttactgttgaagaaagtaaagaagtatatgactggtctgatccaagagctggtaaaacaacagtaagtgaaccagcagcaagaacagttttaaatgcatatacatctgatgctaacggaaatcaggttagtacagattctaattatgtaacaattgaaatgtatgtatcaccaaatgaaggatcacctttcatctataatttggttacaggattcaatacatggtgtacaccatataacttatatgtttcattaaatgatggagcagtattgatatcaggaaatgaaacaatcaatgcattaaatgttacagcaagcatcgacgtagcaggagatggaaagatctgtccacaaggtgaagtattcaacatgaaatcatatacaacatctgatggaacaaattatacatatgcagaattcataccagcagaagatgacaaaaagaatgctttagtaatctggttacatggagcaggagaaggtggaaaagatccatatatagatatattaggaaatgaggtaacggcattagttggagaacagttccaaggattatttgaaggagcatatattttaacaccacaaagtccaacaatgtggatggatgatggaacaggagcatatcaaaacggagataaaggatcatgttatgcagacagtttatttgaaatgatcgatgcatatgtaaaagcaaatgatgatattgatccaaatcgagtaatcatcggaggatgttcaaacggtggatatatgacgatggaaatgatattaaaacatccagattattttgcagcagcatatccgatctgtgaagcataccaggatcaatatataacagatgaacaaatcgaagcaataaaagatatgccaatctggtttacatatgcaaaaaatgatagaacagtaaatccaacattatgcagcgaagcaacgatcgaaagattattagcagcaggagcaacaaatgtacacgtatcagcatttgaagatgtacatgatacaacaggaagatttacagatgcagaaggaaatccataccaatatgatggacactggtcatggacatattttgataataatgaatgttatgatgaaaatggtgtaaatgcatggcaatggttatcaaatcaaactaatgctgagttagtttacgcttcaggaactcaaaaagcctatgttattggtgatgactggggaccagctgtttctaaaacagtaattaaattagataagacaattaatagtgattcagtaaataaagacagctttactgttgaagaaagtaaagaagtatatgactggtctgatccaagagctggaaatacatatgtatgtgatccagtagcaagaacagttttaaatgcatatacatctgatgctaacggaaatcaggttagtacagattctaattatgtaacaattgaaatgtatgtatcaccaaatgaaggatcacctttcatctataatttggttacaggattcaatacatggtgtacaccatataacttatatgtttcattaaatgatggagcagtattgatgtcaggaaatgaaacaatcaatgcattaaatgttacagcaagcatcgatgtagcaggagatggaaaaatctgtccacaaggtgaagtattcaacatgaaatcatatacaacatctgatggaacaaattatacatatgcagaattcataccagcagaagatgacaaaaagaatgctttagtaatctggttacatggagcaggagaaggtggaaaagatccatatatagatatattaggaaatgaggtaacggcattagctggagaacagttccaaggattatttgaaggagcatatattttaacaccacaaagtccaacaatgtggatggatgatggaacaggagcatatcaaaacggagataaaggatcatgttatgcagacagtttatttgaaatgatcgatgcatatgtaaaagcaaatgatgatattgatccaaatcgagtaatcatcggaggatgttcaaacggtggatatatgacgatggaaatgatattaaaacatccagattattttgcagcagcatatccaatctgtgaagcatatcaggatcaatatataacagatgaacaaatcgaagcaataaaagatatgccaatctggtttacatatgcaaaaaatgatggaacagtaaatccaacattatgcagcgaagcaacgatcgaaagattattagcagcaggtgcgcaaaatgtacacgtatcagcatttgaagatgtacatgatacaacaggaagatttacagatgcagaaggaaatccatatcaatatgatggacactggtcatggacatattttgataataatgaatgttatgatgaaaatggtgtaaatgcatggcaatggttagctaaacaaactaaagctgtagatgtagatccagatgtaattgaaccatcagtatctgattctaataattcaattacaacaggcgatgatgttaactttgcaggtctaggtatgttgatcatgttgacagttgcaggagtttatgttactaaaaaaagaatttaattaaactaaaaaagactgtgatgagtaaataattattttacagttttataaaacaaaaaagcgctcaagcgagcgctttttggtataataatttcaaattataactcattttaatcttatttgcgactggatttttctttttcttttgaaaaagatgtttccatgatgatatttgtagaactgttttagaaatcgctcgggaggtaaatataaataagtatgtcgacttctctcacagaaatatccatggttatgatgtttcgttttagtcctgcttgctaaagttgagtaagaccatatatcaaaaagaagtcagagaaaatctagaaagcaaagaaggaaaaaaactaataaataagcagtgcaacagaaagaacatttggtgatataaaagcaaatcaaggatatggaagattacgacgaaggggagaaaatggtgtaaaaaagagatactgttagttggaataagacataatctaaggaaatatcacagatataaataaaaaaacaaagaatatgaagaaaaaatcaataagctagaaattaaaaaaagaaagctagtttcttttttagtgcggcaaaaatacctgaaagtatccaggtaaataaatatttggatatttttttgttatgaatgaggagaaattaaaaacgggacataaaaaagcgaatgaataattaaaaactattcattcgtttttgcaatattatgagaagttagtttgtatctgattctaaaaattttacttctatttcatatgaatcactaattccaggaatagcatttaaatatttttttattgtgctttgtgttttagtagcagcttcacttaataagccattttcgattgcttcttctgctacggtttctttttgcttttttgcaaaagcagtgtaatcagatattgaaataggattaaaaacgtttttggtttcatcgtagacttcaatgctgttttcatctatttcattacttaagatttcaatttctggaatagaaactacaatagtattgttttcaattgacgtttttattttatccattttaataccagcttttaatttaccattatatgtaattaaaaaacttttttgagttaatgggatatcccagccattgaatttgagattatctgaaaatttaccaactttagtataattgtatgacattgtagctaattcttcaatttcttgtaactgctgggtcaaaccagttgcagtaatttttggttcatcactaccactagcaaaccttgttccagcatagaaaataagtattgctactaataaaatcgcaactatgccaccaattgctttttttgttttacctaatgcatctagtattttcatatcatcacctagaaacattataacataattcgacaataatttaataaaataaaaaaagccaaaggcttttttattttacgattgttccatatacttctctaccacaaccagctgcattagattcatctgtatcaatatgcattgcagtagcataattttcacttacacggcaaactacatcaccaaagattaatgaacgaccttcagtatcgattttaacactaacgatttccttatcttcaacaccaaattctttagcatcagcaggtgtcatgtgaatatgtcttttagctgcgattactccacaaggaatttcaacttcaccagcaggaccgattaatttacaacctgcagttccttcaatatctccagattctctaattgccgcttgaagtcctaatgaacgagcatcagttaaagataattcaacttgagtagcattacgtgtaggacctaaaacagacattttttgttctcctttagtaccaacaacagttactttttcaacacatgcaaattgtcctggttgtgaaagatcttttttgtttgttaattgatatccctttccaaataatgtttctaagtcttcatttgataaatgaatatgtcttgcagaagtttcaacgataaattttttagccataattattctcctttttcctttatatatattactctttttgtagctgttttcaagaattttgtaataaattgaaaaaaaattaaaaaaaaatattagaaaaatttattaaaatagtaaaattatattattacaaaacataaaatttatcatttttagaccaaaaaagggtattttcaaaggttttattttaaaaaatatcaaaaaatttagtaaaaagctaaaaagtaaacatctctttacacaattgtctaaatagtgtattatgagtctacactaaaagggggaacctatatgaaagagaatgaaaatctaggattatatgacaaatcttttgaacatgacaattgcgggattggtgcagttgttaatattaaaggtgttaaaacgcatattaccgttagcaatgcattaaagatcgttgaacaattagaacatcgtgctggtaaagatgcagctggtgaaactggtgatggagtgggaatcttgactcaagtaccatacagttattttaaaaaatcaattacacaattcacattaccacaagaaggaaaatttggagtaggaatgttattcatgccaacagatgaacaccttcgtaatcgtgttaaaaaaatgttagagacaattgtttctaaagaaggaatggaatttattggatggcgtgaagttccaactgtacctaaagtattaggaaaaaaggcactcgatgcaatgccttctatttggcaatgttttattaaaaaaccgcatggtgttgaaaaaggtatccaattcgataggatgctttatcaagtacgaagaatatttgaacaaagtaatttcaatgatacttatgtatgttctttttcatcacgaacaattgtatataaaggaatgtttttagtaggacaattacgttcattttttaaggatcttcaagatgaagaatataaaagtgcaatagcactagtacattcacgtttctctactaatactatgccatcttggcaaagagcgcatccaaatcgtttcattgttcataatggggaaatcaacacgatcaaaggtaatgcaaataatatgttatgtcgtgaagaaattatgaatacagatttattagatactaataaagtgtatcctgttgttgatatcaacggttcagattccgcaatgctagataatactttagaatttttagtaatgtcaggtatggagttgcctcgtgctgtgatgatgtgtattcctgaaccatatgataatgataaaagtatgtcacaatctaagaaagatttctatgaatataactcaacattaatggaaccatgggatggacctgcttcaattctatttagtgatggagaagttatgggggcagtacttgatcgtaatggattaagaccatcacgttactatattactcgcgatgactacttaattttgtcttcagaagtaggagcattagatattcctgctgaggatattgttgtaaaagatcgtttgcgtcctggtaaaatgttattagtggatacaaaagctggtaaattaattgaagatgatgatttaaaggaaagttatgcacataaacaaccatatggagagtggttagaaagtaatttaattaagttaaaagatatgcgaatcccaaatgctcgagtagaaagatatcagggagatgagttaactaaattacaaaaagtttatggatatagttatgaagatgtcaacacatatatcaaaaagatggcgcttgatggtagtgaagaagttgtagctatggggaatgattcaccacttgcagtattatcaaaacagcatccgccactatttaactattttaaacagttatttgcgcaggttactaatccaccaatcgatgcgattcgtgaagaaattattacatctacggcattatgtattggaacagagggaaatattttgacagataatgagaaaaattgtcggttattaaaaattgatcatccaatcttaagcaatacagatctattaaaaatcaagaatattaaaaaagaaggttttaaagtagccgttttatcaattttatattataaaaatacttcacttgaaaaagccttagataaattatttgtcgaagctgataaagcatatcatgctggagctaatattttaattttatcagatcgtggtgttgatgaaaatcatgttccaattccttctttattagcagttgctgcgatgaatcaacatttagtaaatactaaaaaaagaatgtctgtggctttgatcttggaatcaggagaaccacgagaggttcatcactacgcaactttaattggatacggtgctagtgcagttaatggttatttagcccaagatacgatttttgaattagtcgatgaaggtttattggataaagattactacgctgctgttgaagattataatgatggtattttgcatggaatagttaagatcgcttctaaaatgggaatttcaacgattcaatcatatcgtggttcacaaaattttgaagcaattggtctagctaaagattttgttgataaatatttccctaaaacagtaacgagaatagaaggaaagacgatcaaagatattgaagatgatgttgactatcgtcatagtaaagtttatgatcctttaggattagatgttgatattacattagatagtcgtggtgatcataaagaacgcagtggtaaagaagaacacttgtataatcctcagactattcataaattacaattagctactcgtaatggtgattataaattatttaaagaatattcagcgatgatcgatgaagaaggaaaagatttaaatcttcgtggtttattgcaattcaagaaaactaaagctatttcaatcgatgaagtagaaagtgtcgatagtattgttcagcgttttaaaacaggagcaatgtcttatggatcaatttctaaagaggctcacgaaacaatggcaattgccatgaatcgtttgaaaggtaaatcaaacagtggtgaaggtggcgaagatccagaacgttttattcctgataacaatggtgatagtagatgctcagcgattaaacaagttgcttcaggacgctttggggttacttctgaatatttatgttcagctaaagaaatacaaatcaagatggctcaaggagctaaacctggtgaaggtggacaattaccagcaggtaaagtctatccatgggttgctaaaactcgtcatagtacgccgggagtagggcttatttcaccaccaccacatcatgatatttattcaattgaggatttagcacaattaatttatgacttaaagaattctaataaagatgcgcgaatttctgttaaattagtatctgaagctggagttggtacagtagctgctggggttgcaaaagcgggagcaggagttattttgatttctggttatgatggaggaactggagcagcacctagaaactcagtgtataatgcaggattaccttgggaactagggttggctgaagctcatcaaactttaattatgaatgatttacggggtcgcgtagttttagaaacagatggaaaactaatgactggtcgtgacttagcgattgcaaccttgttaggagcagaagaatacggttttgctacagctcctcttgtaacgatgggatgtgtaatgatgcgtgtttgtaacttggatacatgtccagtaggtgtggctacgcaaaatccaatcttaagaaaacgatttactggaaagcctgaatatgttgaaaactttatgcgttttattgctcaagagttgcgagaatacatggctcagcttggttttaaaacaattgatgaaatggttggacgtagtgatttattagaagtacgccagggtgttaataatattgatttatcacgagttattaataatccatttataaaagctaaagaaactcatcataatccaaaaaatagttatgattttgaattagaaaaagttaaagatacaacagttttattaaaagagtttaaagtggctttagaaaataatcaaagcaaagagattcatgttgatataactaatatagatcgaacattaggaaccctatttggttcagagattacaaaacgatataaagatactttagatgatgatacatttaaagtaaactgttatggttctggaggacaaagttttggagcctttattccaaatggtttaacattatcacttcatggtgatagtaatgattattttggtaagggattatcaggtggaaaattagtagtagttccaccagagaattcaaattttaaagctgaagaaaatataattgtgggaaatgttgctttatatggagcaacatctggtgaagtatatattaacggtgttgctggtgagcgttttgcggtaagaaattctggagcgactgctgttgttgaaggtgttggagatcatggccttgaatatatgacaggggggcttgtagttgtacttggtgaaacaggacgaaattttgcagccggaatgtctggcggaattgcctatgtctatgatccaaacaatcgcttatatgctcgtattaataaagagctagtatcatatactacagtgactagtaaatatgatgaagaagagttaagaagaattgttcagaaacattatgatcacactagatctaatgttgctaagaaaattttagataattttggcgaacaagtatcattatttaaaaaagttgtaccacacgattataaacatatgatcgagttgattaaatattatgaaaaacaaggcttaagcagtgaacaggctaaagttgaagcatttaacgaagctagaaagggggcataaccatgggtaaaccaactggatttttagaaattgaccgtcaagtaagcaaagcggttgaaccaaagaaaagaattcaaaattttaatgagtttcataagcatttaagtaaagatgaacaggcttgtcaaggagcgcgttgcatggattgtggtgtaccattttgccagtctggaaaagaactagaaggtatggtttctggctgtccgttaaataacttgattcctgaatggaatgatcttgtttatcataataattataaacaggcactaagcagattattaaagactaataattttccggaatttacttcaagagtatgtccagcattgtgtgaggcagcttgtatatgtggattaaatggtgaacctgtaactgttaaagaaaatgagcatggaattattgaggatgcgtacgctaaaggtttgatgaaaccctgtccaccaactcatcgtattgataaaaaaattgcgattgttggatcaggacctgctggtttaactgctgctgaccaattaaataagcgcggttatcaagtaacagtttttgaacgtgatgatcggatagggggattattaatgtatggtatccctaatatgaaattagaaaaaagtgttatagattgtcgcatcagtatcatgaaagctgaaggtgttacttttaaaactaattgtgcaattgaagatagaaaacaggttaaagaattattagataattttgatcgagtaattttagcttgtggtgctcgtaaaccgcgagatattgatgttccagggcgtaaaggtaaaggaatcttgatggctgttgactatttaacggctgtaactaagtctttattaaatagtgatttaaaagataaaaattttgcttctacaaaagataaacatgtacttgtaattggtgggggagatacaggtaatgattgtgttggtagtgcgattcgtctaggctgtaaaagtgttactcaattagaaatgatgcctgaattaccagaaattagaagtgagaataatccttggccgcaatggccaagggtcaagaaaacagattatggtcaagaagaaagtattgctgttttcaatcaagatccgcgtatttatcaaactactgttaaagagtttgttttagataaagatggacatgtaaaacaagctgtaattgtgtcgttggagccaaaagaaaataaaacaactaaacgggtagaaatggtacccgtagctggtagtgaaaaagttattcctgctgatttagttttaatttcagctggatttgtgggatgcgaagatcatgtggcaaaagcgtttaacgtttctttaaatccccgcggtaatgttgtaagtaatcacaattaccaaacaaatattaaaaatttatatgttgcaggtgatatgcgtcgaggtcaatctttagttgtttgggcaattagagagggacgagaagttgctagagctgtagatatagatttaatgggatatagtaatttataattataaaaatgtctgtatttttcacagacatttttaattttgtgataaagataagattaatttgagattattttattattgtttaatggtatgatttttatggatgatcatctttatttagggaggtaacaataaatggaatatttatcgtatcatctaataataatccgcgaagcgttgactgaagtattcaggctgaatttagatagagaatattattagctaaagtaactgtcgaattcgggattataatatttagatgtaaaaatcaagaactataataaattttatgatagtgtatatgtaatttgtgaaaagaagataatatgaataaaaattagtatttaaaaagatgtaattccaatatagtttatctaactaagctaagaattacatcttttcattttttatagtgttaaagaaggagcgctatatacacgattagctaattcactatcaagcatgtataatcctttaggatcatttccaaataaatcgaatttagtaatcatatcattagcattagtttcttcttcaccttgttctttaacaaaccaatcaaggaattgcatcgttctaaaatctttgattgaataagcagcatcataaagattatgaattaaactagttacatattcctcgtgttctaatccctcaaccaaaggatcttttaaggcattaagatttttatcaggcttgtcaatagcttctaagattactctttcattgttgttttgtaaatattgaacaaataacatcgcatgatctctttcttcctgagcttggatattataccaatttgcaaaaccatctaatcctttatctttataaaaatttgcgaaatctaaataaagatatgcagaataaaattctttattaacttgatcgtttaataattcaactatttttttatctaacattttattacctcctaccataaatagtataaacttaatttaatccaatgttaatagaaaaatgtaaaaaaatgctgcattgttaattagaaacatttgtagttaatgctagatcgtatattaaaagctgctttgatataaactgttatagtaagtttataactaaataaaattgttgtaatttgccgacttaaagaatcttaaatatatgataaaagatttttaatttataaatgttaatgttataatagaccatgaaagaaggtgtatttgatgccaattgtttctgcaattacatttaatttaagttcaatatttaatgtggttagaacaattattgatttaattttagtctggtacgttatttatgtactggtttcaatgatgagacaaaatatgcgaacaatgcaactgtttaaaggggtattgttgattttaattttgaaaatgtttacaagtttactaggtctaagtgcaatggactatttagttgatactgtacttacttggggagtgattgcggttattatagtatttcagcctgaaattagaggtctattagaaaagatcggaagaactaaattagagattaaacataataatttgacagatgacgaaaaagaacgattaatggatgaattagttagtgctattacaaagttgtctgaggatcaaactggagcgttgatcacatttgaaagagaacatactttaattgattatatcaatactgggacaagaataaacgctgatataaaagcagagttatttacaacgatattttgggaaggaacgccgttacatgatggggcaacgatcataaaagatgatcgtgtggtatgtgcagcggctttttatcccccaacgaatcaggaattaagcccattgtatggagcaagacaccgagcagcgttaggaattagtgaaataacggattctttgacagtcgttgtatctgaagagacaggaacgatttcatttgcaactgatggaaaattgcggaaaattccacgcaaagagttacgtgcttctttggttaatgagctggattggtttaatacaaaagaaaaggatggtgaaaaagatgtcaaaaaaggataatcaaaaaccatcaataaaaaaggattctacaactgacttttttttaaattttataactcgccaaaaatctgaaaataaaaagaatgataaaccggtagttactaaaattaatgaagattcatttagtgtaaaagataaagcttttggaattatttataaaacagtcaattctttaaatgtttttttagatcggatgttacaatccaatctttcaatgaaaattttatcttttattatggcagtagtgttactgtttacaataaatggtagtataaataacattttttctacacctaatgggggtgattacatcaatgatgtaaatattgatgtccaaggattacaggacgattatgatgttgtgggtctgccatcaactgtaaatgtagctttagtaggtccatcattagatatctacactgccaaaatagctaagaattataaaattattgctgatttctctggtcttggagaaggcgatcatactatagagttgaaaagtgaaggcttttctagtaatttacaagtaatgatcgttccacaaactgtaaatgttaaaattacccaaaaagttacaaagacttttgaactaggatataattttatcaatgaagatgagatggatagtaaatattctgtttctgtagagtcaatggaacatgaacaagttgaagttcgtggttctcaagatacgattggtaaaataaatacagttagagcagcaattgatttaaaaggtgttaaaaaagattttgagaaaaaagcaaaaatatatgcttatgatcgaagtggtaaaaaacttgatgttgagattattcctaatacagtcaaggtacaatgtgatgtttcttcatatagtaaagaagttccgatcgttcctcaatatacaggacaatttgaaagcggatttggtttagagagtattactttatctaaagacaaagttaagatatatggtaaagaagaattgcttaatagtgttgatagtgtgtatgtaaccattgatctttcaggattaagcagtgataaaagctatacaaagttagcaattacaggaaccgaaaaaattaacaaactggcctttgatacagttgatgcaactttacgtgtttcacctgcagagaaaaaaacaataacagatatcccaattaatataattaataatgaaaataattataaagtgacttttgctagtggacaagataaggtctctgttgaagtagaagctgtagaagcaaagttgaatgaagtatcaattgcagattttaatgcaataattaacttggaagacttgaaaagtggtactaatactgttaaagtagatttaacttcgaataaagggtatttgagctataaattagtctcacctgaaaaaataacaattactttaagaaaataggaggaaaaaagtaatgggtaagtattttggaacagatggatttagaggggaagcaaacgttgacttaacagttgaacatgcttataaagtagggcgctatctaggatggtactattctcaaaatggaaaagcaaaagttgctattggtaaggatactagaagaagttcatatatgcttgaatatgctttagtatcaggacttacagcaagtggtgcagatgtttatttattacatgtaactacgaccccttcagtttcatatgtagtggcaagtgaagattttgactgtgggatcatgatttcagcttcacacaatccatattatgataatggaataaagatattagatggcaatggtcataaaatggatgctagagttgaaaatttaattgaacagtatatagatggattgattgatgaattgccatatgcaacaaaagacgagatcggatgtgctttagattattcaatggggcgaaatcgttatattggctatttaatgtctattccaactagagcatttagaaattatcgggtcggattagattgtgctaatggtgctagtagtgcaattgcaaaaagtgtttttgatgctttaggagctaaaacatatgtaattaatagtgatcctgatggtttgaatattaatactaattgtggttcaacacatattgaagtattacagcaatatgttaaagaaaatgctttagatattggttttgcctatgatggtgatgctgatcgttgtatttgtgttgatgaatttggtcgcgttgttgatggtgatttaattttatatgtttgtggaaaatacttaaaagatcatggggaattagctaatgatacagttgttacaacaattatgtctaacttaggtttatataaagcatttgacaaagaaggaattaaatatgaaaaaactgcggttggagataaatacgttaatgaaaacatggtgaaaaatggtcatgtattgggtggtgaacaatctggacatattattttttctaaacatgcaacaactggtgatggaattttgacatcattaaaagtaatggaagctgtaattgaaagtaaacgaacaattgcacaattgattgaaccagttacaatttatcctcaattgatgaaaaatgttcctgtacgtgataaaaaagaagctcaagaagatcctgatgtaaaggctgtgattgcagaagtggaagctgctctaggtgataatggtcgggtcttagttcgtgaaagtggaacagagccagtagttagagttatggtagaagctgatagtgatgaaaaatgtttggaaaatgtaagtaagatcgttaataagatgaaagaaaagggatttgttataaaaagataaaataacataatatcacaaaatattgccatataatatggcaatattttatatatattaaaagtgaggtgaaatacatgcaatttaaaataaatataatcgatgatgaaaaaaatttaaatgatttagtaagaacttatttggaaaaagaaggctatattgtgtattcattttatacatatgatgaagcattaatgcataaaaatgatgatgttcatttatggttgatcgatattatgctggatcgatcaagtgggtttgaattatttaatgaaataaagagtattcgtcctaagatgccaattatttttatgtcagctcgtgaccaggaatttgatcgaattattggattagaaaaagggtctgatgactatattacaaagccttttaatattaaagaggttattttaagaattaataatttaattaaacgatcatatgatgatccatcaaaaattaaaatggatggttatgatattgatttagaaaaaagaagggttttttgtcaaaatgaggaaattgttttaacaactaaagaatacgatttattagtttattttattactaataaaggattagctatttcacgtgaacaagtcctcaataaagtttgggatgaaaattattttggtagtgatcgtgttgttgatgatactttgagaagacttagaaagaaaatgccagaaatcaatgtacgtacaatatatggatttggctaccgtttagactaatgttaaaaaagttctcgttacaaaggcaattgattattattttttcattaatagcattagttgtcttagcaattttagtacctcttatcaataaaaatttaaataatttaattgatagtcagatgtttcaaacattagaaacagcacaacaaggatatgttgattatggatatagcccaattgaaaaatcatcagataaacaaatttatcatatgacatatgatgctgaaaataatgtgctaattccatcaacaaatataacatataaagaagctgaaaaaataagttatgtttttagcgagtgtttgtttgatatgattgatgatggtaaggagaaggttcagaaaaaaggtgacttttatgggactactgtttattatcaaataaccaaaaaagatacgaatacatatactgtttctttagtttatagtgattattcagcaaatctaatttcagcaataagacaacagataataaatatcctttatgtttcatttgcaattattggagttgtaatatttttatgggtcagtagcttgataaaacctttaaaagcaattagaaattatattgaagatataagaaatgataaagaaggcgaattaaaaatagatcgtagtgatgaaattggaattgtttctaatgaacttgtagtgatgaaagaagaaatagatcatcaaagtaaaactaaagaggaaatgattcataatatttctcatgatttaaaaacaccgattgctttaattaagtcatattcacaaagtgttaaagatgatgtttatccatatggtgataaagattcatcaatggatgttattattgaaaatgctgatcgtttagatagtaaagttaaaagtttattatacttaaatcgtttagattttctaggtaataaaaatattgataatgaagtagatatgaaagcattgattgaacatataacaattcaattacaaggaatgcatccagaaattgaaatagaaacagatttggcatttgtttcttttaagggtgatgaagaatgttggcgtatctgtgtagaaaatattattgaaaatgcatatcgctatgttaatagtaaaataaaaataattttaaaacaaaattatttagaaatatataatgatggtgaaccaattgataatgaaaacatcgaagctttattcaaaccatacgaaaaaggaaccaaaggacagtttggcttagggttatcgatcgtctataagacatgtacaatgtatggatacaatgtaacagcagaaaataaagatgttggtgttagttttattattgaaagaaatttaaatggatagtttaggctatccattttatgttaagataatcatatatggaggtagagagatgaaactactatttaagcaaaggcttttttcctggtttgatagctatgatatatatgatgaatcgggaaatgttgtatatattgtaaaaggagaattgagctggggacataaattgtgtatctatgatgctaatggtttacatattggtacgattaaagaagagatattaacgattttaccgcggttcaagatgtttataaatgactgttatattggacaaataaaaaaagagttcacttttttaaaaccagtattttatttggattgtaatgattggcaaataagaggaaattttttacaatgggattatgaaataattgatagtaatggttttcttattggaaatataaataaagaaatttttaactttactgatacttattctttagatatagttgattcaaaaaatgcattacaggtattaatgatcgttttagctatcgatgctcaaaaatgctcagagggaaagcattaaaatgattgatgataaaaataattttgcccatggcagtgttgtttgccatattattaatttggcaggaccgatgatcgttgcacagcttatcaatgttttatataacgtaattgatcgtgtttatatcggtcgaatacctgatgttgcaactctagcaatgggtggtttaggattatgtttaccgttaatatccattatcattgcctttgcaaatctatttgggatgggtggagcaccactttgttcaattgcaagaggtcaaggaaaaaatcaagaagcagaagagataatggctaattcatttattttactggttatctttggaatcattttaatggtcattggcttttgttttaaagaagatttattatggttgtttggcgctagcaaaaagacgctaagttatgctaatgaatatatgagcatatatctattaggaacagtatttgttttaattggtttaggaatgaacagttttattaatagtcagggttttgccaagatcggaatgttaacagtattgataggagctgtagttaatattattttagatccaatttttattttttcttttaaattaggggtacagggtgctgccctagctactatcatttcccaatttatttccgctttttggactttatattttttaactggaaataaaacaatactaaagttaaaaagaaaaaatatgtttttacagaagaaatatgtaacaaaaatattttctttaggaatggcggggtttatgatggctatcactaattcgattgtgacgattgtttgtaatgcaacattacaaacatatggtggtgatttatacattgcaatcatgacaattattaattcaattagagaagttgcctctttaccaggacaagggatggctaatgcctatcaaccagtattaggttataattatggagctaaaaaatattctcgggtactacaaggaatcaagtttgtaactttaagtgccttatcaatgatgctgatactttggtttgcaataacagtttttcctgatttatttattaaaatattctctcataatcaagaaataattaaggatggtataagagcattaagactatatttctttggcttttttatgatggcttttcaaatggtcggacaagcagcggcaattggtttaggtaaagctaaacaggctattttcttttcagtatttagaaaagttataattgttgccccattaacaattattttacctgtttacattggtgtagatgggatttttattgcagaagcaattagtaattttatcggtggtggagcttgttatattacgatgtggctaacgattggcagaactttgaagaaacaagtttgattgggcagaaaaaacaggttaataattctttaaatataaagattttaacctgtttttattatgaaatttgaaattttaatattatttataaatatttattaaaagaaactgtataagtgatgtattgattaataaggtatttattgttttgttattattttatttatgttaatatataaataaaataatagtaagattgtggggaagaaaaattatatgattacagtaggggtagtagatgatgaacaaatattttgtgagatgataaaagatattttattgcaaaaatttgacgatataaatattcatacatataattcagtaaaacagctggataaagattttgactttatattaatggatatcaatatgccagatactgatggaattgagtatgctaaaaagaatgaagataaaaaaataatatttgtaacttgtcatgatagtagatgtagagaagcatttggaccaaatatttatgggtttattgataaaggtaatttagagatagaattagttgaaaatatttcaaaaatgattgcgagaattgaaaaaaatcgtattacagttgaatttaaaacaggtagagaaaaaattaagataaaagtaagtaaggtcatatattgtacatatctaggagatatgaatactgctataataatcgagaataaacaaatagtaataaaaaataaatcttttaaggaagtattagaatttttaggtgatgattttataaggatcagtcgaagaacagctatcaataaaaataaaatctctactatatctgataaaggtatttatttaaaaggagaaaaaagattattaaatgttagtcggcgacaaaaaaagatagtattaaaagctttttttgagagttttatgaatgattgattaaatgactttattatagctattaccgtttaattgtaattttgaccgttagaacagggaagtaacaattccctgtttttttatgctatagtgtaataaagaaggggaatgatgtaaaaaaattagcgatataaatagtgaatttttaaattataaaaattaaagaaagttattatagttatcattataaaatatatagtttataaatatttaattaattagataagttaggaggcgaaatatttatatcataattattaaatagcgaagtatgtataattgtaataggtaactatataatagaatatttgtgagtatacaaaagatagatttttattacatattgataaattacgaagtatatcgttaatattatttttattatcccataatatgaggagaaatgggtagaacgatttaaaataatatatttgaaaatagtagataggtgagtgaatttatgaaagttaaacttataaataaaaaggtggcgataggattactacttatattactgattgttggtattaaaatctataatagtaagtctgcaaatgaaattgataaaagtttatgtcactttcaatatggtgttcgttatggtcttgatgctccggataataagcatactgtgatagtagatatatgtaaagaagataaaagtagtaatgtatcatatataaagggagatttggcggtttcaaaagatcgtgtttatcacgttttaaaaactatttattggcaaaaagtagcaagcagagaagtatcaaatggtttagatggtgacgagtattgggaaacgtgtgatgttgaatggatagataatcaacatattcaaatcaatggtagagttgttgatatttataaaggttatgattatcgtgataagaaaaactgataataattaaacagatagaacgtatttttatttgtttaaagtaaaaagcaatctgaaatacttgaacataaaggagttaactttattttaagtaaagtaattgtaaaaaattgtataaatggcaatgtagataagggaaacgaaatcgaaattttgcaaactgttattgataacaatgaaatagaaatattatcattagataaagattatgttttatttttagaaaaatatcgtggaccaattgttaaaaacgcttatgttatcagtggcatgaatctaggaatgttaaaagtaacgggagaagaagtttaattaaataaattacagaatgataattttagaatttttaaaaataattctaaaattcacaaaagggaattgatcaatgaaatatcaaaaaggattgaataaatttaaactgctgattttatttgttgtttttattttttcagggtgcagttcggtaaacaatttaaaatttaagaatattgtaaaggttaatgatgtatattatcaaaaaacatctgacgtggtttctctggatgaattaggtcctgaattgggcaaagtaaaattaacaactccaaaaactaatggaaagtatgaatttgttaattatgaagcaagtaaattagaagttggaacaaaaatctataaattagaaaatgaaaattttattgcagtagaaatacagggtactgatacggtttatcaaaagtataaaataatttcaccagatgacataattgaaaaataatcataatataaattatttcaataggctgataaatatagctaaaagtactttcaaataagttgattttatcttttttaaaaagaagaagttaattaaatgtgaggataagaattataaaatctataggattactgcttgcaatgttggttttaaaatatgcaatattcagcctgcaaatgaaattgataaaagtttatgtcactttcaatatggtgttcgttatggagtttccaaaacaaaaggatattaagaaataacctgtgtttacctgcttgcaaaaaatatgatatataagagaatggcacttgtaatatagtgcctttttctatattttaaacaaatttaattaggtaatcgaaaaagaatgaccgcttatttttctagtgatataatgaaaaacatagaaaacaataaattggaatttagtgagataaaagaaatggtagaaattagatatgttcaatcagaagataaagaattttggtatagtcttgatagtcatttgccagaacaagaatttaacaataaagttagtgataaaagaggatatgttttattagatgacaataaaccaataggattgttgagatataatcttttttgggataatacaccattttgtacaatgttatttattgattggaattatcacagaaaaggttatggaaagaaacttatggaacattgggaaaatgatatgaaatcacaaggatatggcatgcttttgacatctacacaggttgatgaagaagcacagcatttttatagaaaattaggatataaagattgtggtggttttgttatagatgttccaggatatgagcaaccaatggagatgtttttaattaaaggaatctagcaaattcaatttgtcgggaactgaaaatcccagtttacaaaggaaacgatgaaggaggttatatgaatgaacaatcgaccagagtttaacgaaattaagtcatatgatgagtttataaaatattattggtatagagaagaattatcaaaaatatgtaaacaactcaatgttgattatacaggaacaaaacaggagttaaattataatattaaggaatattttcaaggcaatttgattagaaaaaagaaatcacatattgcttaaaagtgtcgttaaagaaattatattagatagtccattattatattgtgatttttattttaatacaaaatttagagagtttttttctaagcaaactggtgttgttccttttaaatttacagcagatattacgcatgcagtttttatggacagtttggcaaaggctactgttccatgcactatatccgttatgacgtactttatgaagctgtattggaacgattatagtattgggcgaaggctgtttagcaggacgaagaaaaagtcttgaaaaagatacagaaagtcggcaatgcagagcgaataagggaaaagaagaaaaagacagccaagttaaagaaagctgaaaactgtcaaaatgaaattgaacgcttatttgcgaaaatgtatgaggacagagccagtgagaagataacggagcgaaacttcattatgttgtcgggcaaatatcaacaagaacaaatcgagctggaaaatgagataaaaaacctaagagaagaattaaataaaatggagcaagatatgattggtgctgaaaaatggattgagttaatcaaggaatattccatactaaaagaactgactgcacaattattaaatgccatgatagaaaaaatcctcattcatttggcagaaaccaatgagaatggggagcgaatacaagaaatcgaaatatattaccgatttattggcaaagtcgatcgataaacaagagcaatatttttaactaagggaaacaagtcttgatgctctggataataagtatactgtgatagtagatatatgtaaagaagataaaagtagtaatgtatcatatataaagggagatttggtggtttcaaaagatcgtgtttatcacgttttaaaaactatttattggcaaaaagtagcaagcagtgaagtatcaaatggtttagatggtgacgactattgggaaacgtgtgatgttgaatggatagataatcaacatattcaaatcaatggtagagttgttgatatttataaaggttatgattatcgtgataagaaaaacggataataattaaacagatagaacataatttctatctgtttttgataaaatatatgtttttataacagcttatatgttataaaaacataaagagatgataatgttaataattaataaaaaattgataatattttatttaatggttaaatagtttttattgttagtaatatcgttattgaaattgtattttttgggatttgacttattatatttttaatagaaaataattttatattaatatgttgaaggacagctattaataaaaataaaatttctaatgtatttagataaaggtgtttatttaaatggagaaaaagattatttaatgtaagttggcgacaaaaaagatagtattaaaggcttttttgaaagttttgtaaatgattggttatataacgattaccgtttaattgtatttttgaccgttagaacagataagcaacaattctttcttgtttttatgttatagtagaagtatagaagtgattatataaaaaattaatataaactatggaatcaaagaaggttattatagttactactgtaggatctttgaaagctgaagatttaattaatcaatcagatagttaggaggtaaaatatttataatatcaagatttattaaataataaagtatatatagctatgatagtgactgttataatagtaaatctaaaaataaattactttatttctggtttacgataaattataaaaagaagtaaaatatattatcactagtctgctatatgtagcattaataacattgacatgtttaaagactatatttttttgaatatgatgatgtcattgtaaattatgaaaaaatttaaataataattaattacttgttcaatcaactagagcagataccttacaatattaaaccaacagatcatgtttacctaaaaacttgacctattctattattttagtagttagcggttattctggattccctagttaggctgttgaagcatggataactgctgaaaaaattttatgaagtatatgattcaacgggatatttcttggatacaacaaaaacagaagcaaaaattaatggaaaaaggcaattggtggatacacaaaaaggaaactatactacattatatcctggataataattatcttaattaacggggagattacaaatgaaaatttataagaaggttgaattttatatattattaattttaggtgtcacatttataattttgatgtttaaaaaagctttattggaagcaatagttctcatgtttttgtttatttcgatggctattaaagatatatgtattaatgtaaaattagatatagataatgaaagagttagagcagctgcctgggttttatttaatgatatacttggtatatgtttaacaatttataactttatttttggggagcttattatagggatagtgttaataatttttattttggtaattacttatcaaagtatcatgattttaaaaaaataaagtaatgattaaaaaaatcttataaaataatattaattaaatcaatcatatctgttttatcataaacaaattaaaaaaatggggtgaaaagcgatgaaaagacaactgattattttattgggagtttatgttgtatttatgattagcggttatttttggtgtttattaaaaacagattctattaacctaatagaggtttttgttaaaacggctttatggtctattttaggatatggtttgtggtttgttttggttgttttagatcgtattagtgtattaagtaaattaattaaaaaattagatatgcttacaccgtgttttttatatgtgtatttaatatgctttttggttgaagcatttattggacttttaatggttgttttctttaaacgttttgattattcatatacttattttgcgatattaactgtcttacatgcaacaaagctttctaaaaagattattgatcgttatcattatagctagtagtgtaatgagggaaagattgtgaaaaaatttctgattttgatagatatgttttatataatatgtattttagttatattgtatttgtatatgtgttatagcttaaataataatttgttatcattttcaatgattttattattagggggaatgattttgaattggtatttatggcatcgattaataaaaaagaaaaaatgatttaaaacgtcttcttattgatagaagatgttttaaattgtgatatttttagttgatgatacaatctaaaattgttgtggtataataagtaagttcatgaatagttaataataaaaaaatatactatgtcatagaaatttaatattggggtgcttatatgaaagataaattttatcaatttatgcaaggtagatatggtagtgatcaattaaatagttttttaattattatcagtattatttgttttattattaatatttttattagtaatattgttattgaaattgtatttttggtaatctggtttattgtactttttagaatgttctctaaaaatatatatgcaagaaaccaggaaaatgaaaaatatttaaattttttaagtcctttaaatcgttatttaagacttaagttgatgaatcagcaagaaccaacgcataagcactttgcttgtcctaattgtaaacaaatggtaagagtgcctaaggggcatggtaaaattattattacctgtccaaattgtaaaaataaatttgaaaagagaagttaattatgtttggttatgtagtaataaataaaccagagatgaaatttaaagagtttgatatctatcattcttattattgtggtttgtgtaaaacattaaaagataaatatgggttaagagcacaggtttctttaaattttgatatgaatttcttagccatcttattaagtggtttatacgaacctgatacaaagcttaaaaatgaacgttgtatcatccatcctttaaaaaaacatcaggcacgttataatgaatgtgtcgattatgcggctaaaatgacaatcgttttaacgtattttaaatgtgaagatgattggctggatgaaagaaagattagtcggcaaacatataaaaaactgataaaaaaagcctataataaggttaaaaaagagtatcctgataaagtagatgaaatagagaagtgtttgcataagatcaatgattatgaaaaacagggtttaaataatcttgatgaagtatcaaaatactttggtagagtcatgggactcatttgtgcttataaaaatgatgaatggtatgatgagttgtatgaattaggattttatttaggaaagtttatttattttattgatgcttatgaagatattgaagatgatttaaagaaagaaaattataatcctttaaaacaaacatatcagacgacgcagtttgatgagcgctgtaaagatattttagagttaatgatatcagaggctacgatggcttttgaaagaatgccaattattgaaaatgctgctattatacgtaatatcttatatagtggtgtatggactaaatatgaattgatcaagaaaaaacgaatggaaggtaggaaataatgaatccatatcaaatattaggaatagatccccaagcaagcgatgacgaggtaaaaaaagcgtatcgaacattaagtaagaaatatcatcctgatgctaatataaacaatcctaatcaagctgcttatacagaaaaatttaaggaagttcaaactgcttataaaacaattatggatgatcgtaaacgaggttttactaatcgtaattatggaggtaatcaaaatactggtcagtatagttatcaatatagtggtaatgatcaggctgcttttaatgaagcggcaggttttattaacgcccgaagatatcaagaagcacttaatgtattgaatcaaataagaacgcgaaatgcaatgtggttttattatagtgcaattgctgaaaatggtgtgggtaataacattaccgcagttgattacgcccaaacagcagtgcagatggagccaagtaatttacaatatttattattattacagcagttacaaggtggtcaaaggcagtatcaaacaggtcggcaaacatacgattcgccgtttggtgatatgacattttgttataatgtaatgttatgcagttgtttattaaattgttgtggctgtagaatttgttaaaaggagagaataaagatgagtaaagtaattggaatcgatttaggaactacgaatagttgtatggcttatatggaaaatggtaaagcagttatcattcctaatagtgaaggtaataaaacgacgccaagtgtagttgcatttacggctgatggtaaacgtttagttggtgaaaacgctaagcgtcaggcggtaactaatcccaataatacaatttcttcaatcaagcgtgaaatgggaacaaattatcgtaaaacaatcaatggtaaagcttatagtcctcaggaaatttcagcaatggtattacaaaagttaaagatcgatgctgaggcttttcttcaagaaaaagtaactgaagcagtaattacagtaccagcatattttaatgatgcgcaacgtcaggcaactaaagatgctggaagaattgctggtcttgaagtaaaaagaatcattaatgaacctaccgcagccgctttagcatatggacttgaaaatagttatggtcaaaaagtaatggtttttgatttaggtgggggaacttttgatgtttcgattattgaaattggaaatggtgtgattgaagttctttcgacctcaggtgataatcatcttggtggggatgattttaatgagtgtgttgctaaatatattgttgaagagtttaaaagagctgaaggaattgatttaagtcatgatcaggtagcgatgcaaagaatcaatgaggctggtgaaaaagctaaaattgagttatcatcaatggttacaacaattgtaaatttaccatttattactaatacaaatacggggcctaaaaatttagaagttgaattaacacgcgctaaatttaatgctttaactaagaatctagttgaccgccttgttttaccgatgcaaaatgctttaaatgatgcaagattgactcctgcagatttaaataagataattttagtaggaggatcttctagaattccggcagttcaagataaaatcaaggagataacgggtaaagaagctagtaaatctttaaatcctgatgaatgtgtagctttaggagcaagtattcaaggaggtaagttatcaggtgatgttagtacaactggtaattttgatgtgttgttattagatgtaacaccattaacgctatcgattgaaacagtcggtggggtagctacaccattgattgaacgtaatacaactattcctactagtcattcacaaatctttacaacttctgcaaattttcaaactcaagtagaaattaatgttttacaaggggaaagaccgcttgctaaagataataagagtttaggtaaatttaaattaaagaaaattaaaagagcgatgcgaggagtaccgcaaattgaggtaacatttgatattgatgccaatggaatcgttaatgtatcagctaaagatctagctagtggaaatatgcaaagtatcaccattgaaaatacttctaatatgtctgatgctgatattgaaagagcaattcatgaagctaagcagtttgaacagcaggacgctcttactaaagaacgtttagtttttaaaaacgaggtagaaaatctggttctttcaattgaagctgctttagctaaaaatggtaaacaaattgataaagcaatgaaatcgaatattaaaaatgaacttgctagttttaaaaagttaactaaaaaagttgattttgaaacttgtgaccaggctaagtttgatgaaattaaaagtgctaagatcaatttagaatcagtagctgcatcattattatcaatgcaataaggtatttgctataattgtagcaagtggataatagattctagttttgttactagaatcttttaattatgtaaagaaataatgtataatggaagaaagagtatatcttgaaataatatctggtgtcttgttaactatttcacttgacaatgggtgtgatttatgggatattttatctaatgtacaagaactttgaaatggggatagttatatgaataatattgttgatgaaattaaaaaactaaaagaagaaagaaatgctgttattctagcacattactatgttgatggagcaatccaggatattgctgattatttaggagattcatattatttatctaaaattgctgtagattgtccacaagatgttattgtgtttgctggagttgagtttatgggcgaaagtgcaaaacttttaagtcctaataaaacggtcttaatgccagacagtgaggctgattgtccgatggcacatatggttgatgagtattttattgcgcgaatgcgagaaaagtatgaagatttgtgtgttgtatgttacataaattcaacagcagagatcaagacgatggctgatgtttgtgtaacatcatcaaatgccaaaagaattgtagaggctttgccaaataaaaatattttatttatacctgatcaaaatttaggtaaacatattgctaagatcgttccagataaaaattttgttttttgcaacgggtattgcccaactcattatcgaatcaaggttgaagatattcaaaaggctaaacagttgcatcctggtgcaccagtgttgattcatcctgagtgccgaccagaatgtgtagcgttagctgattatgctggtagtacatcgggtattattgattatgctactaatgatcaagaacatgatgaatttatcgttgttactgaagtaggggtaattcatgaaatggaaaaacgtaatccagataaaaaattctatccagcaacagataaattagtttgtccaaatatgaagaaaaatacgcttgaaaaaatcagagattgtttaaaaaataatacaaatcaagttattcttgatgatgaattcatggtcaaagctaaaaaaccattggaaagaatgcatgaactagcaaaataagaaggtggagaataatggataataattttgatgtaatcattgtcggaacaggagcagctgggctatttgctgggctatgtttaccacgtgatttaaagattctaatgattactaaagataaaattgaaaatagtgattcttacttagctcaaggtggaatttgtactttaaaaagtgctgatgattttgatgccttttatcaagatactttgaaagcaggacgtaatgaaaataatcctgaatcagttagaataatgattcaacaggcaccacagataatgaaagatctaatggattatggagttgaattcgatcgcgatagtgaaggaaatttggcttatactcgtgaaggagcacattctgaatttagaattttgcaccatcaagatgttactggtaaagaaatcacatcaaaactaattaaacaaattgaattatgtagtaatattacagttattgaagatgcaacgatgctagatattattaatgataataatagagtaacaggaattattatggaaaataataacgaaatcgtgcaaattaatgctaaggtcgttattctagctactggaggaatgggtggtttgtttgaacattctactaattttagacatattactggagacagctttgcaatagcgttaagaaataatattgaattagagaatataaattatattcaaattcatccaactactttatatacaactaaaccaggaagaagttttttgatcagtgagtcagttagaggcgaaggagctcatttattgaatccaaatatggaacggtttgtagatgagttattaccacgagatgtcgttagtaatgcgataaaaaaagaaatggataaatataatagtccttatgtttatttatcagttatgcatatggatcatgatcagattcaaactagatttccccatatttataagcaatgtcttgaagaaggttatgatatgtatcgtgaaccagtacctgttgttccggctcagcattatttgatgggaggaatcaaaagtgatacttttggtagaacttctatggaaaatttatttgctgttggtgaaacagcatgtaatggtgtacatggagcgaatcgtttagccagcaattctttattagaaagtctagtttttgctaaaagagctgctagagtaattaaagatgaaatcaataaaatcaattttgatccacagtatatcaatattagtaaatacaacaaagataaattaatgattgataatagaagaataattatggaagaaattaaaagaaaagacggtgagttctatgataaatggtgtaaatcttaaggttaatatcgatgattatattttaagtgctctaaaagaagatattacaagtgatgatgttacaactaatgctgttatgcctgaagctaagttgggtcatgttgatttaatttgtaaacaagatggaatcatttgtggtttagaagtttttgaaagaacgtttaagctattagatagcaattgtaaatttaccactaaatatcatgatggtgataaaataaaaaaaggtgattatattggtgaagtaattggtgatatcagagtattattatctggtgaaagagtagctttaaattatttgcaacgaatgagtgggattgcaacatatactcatgagtcggtagaaatcttgaaaggttttaaaactaaattattagatacacgtaaaactacacctaataatcgtatttttgaaaaatatgcagttaaaataggtggtggaacaaatcatcgttataatttatcagatggagtgttgatcaaagataatcatatcggagcagccggaagtattactaaagcaattgaaatggcacgtgattatgcaccgtttgttcgaaaaattgaagtagaagtagaaactctagaacaggttgaagaagctttaaatgctaaagcagatattattatgttggataatatggataatgagatgatgaaaaaagctgttatcatgattggcgataaagcacaaagtgaatgttctggtaatgttactaaagaaagacttttagaaattgctaaaataggcgtggattttgtttcttctggggctattacttatggagcaccgattctagatttttcaatgaaaaacttaaaaccttattagatactgaagtttcagtatcttttttattttaaaggacataattttataaggtgataaaaatggaaaatgaatcatattggcaaaaaacagtaaaactgccaaactatcctaaaatagaagctgactgtaattacgatattgttataattggtgggggaatgagtggcataactttagcttatcgtctgaatgatagtaattttaaagtagcattaattgaaagtgataacctagcaagcaaaacaacagggcatacgacagcaaaaataagttatttacatgatgttctttatgaagatatttgcaatgcttatgataaaagtaaagctaaagaatacttagattctaattacgaagctttacaagaaatcaaaaatattattgaaataaaccaaattgattgtgattttaaagaaaatcttgcttatattgaagctaaagatagtgaaaataacaaaaaaatcgtaaatcaaattaaattatttaaatcatggggatttgatgttgttgaaaatgttactaatgatggatatgtatcgatgggactttatcatcaagctatatttcacccattaaaatatcttaaaggaatattagaaaaatgtgataaaatagatatttatgaaaattcattagtaacaaaaaaagaaatcaaagataatgaattttatttagaagtcaacaaaaagaaagttcaagcaaaaaaaatagtttggatgacacgctatccacctaatttacaaaagggctatttttttaggattttacaagaaaaagaacatgttatttatagagaagggaaaagacaaaaagatagtatcttgaatttaactactaatttttctattcgtccagtaaatgaaaatgcagttattgaaataaataaaaattttactaaggatcaatggcattggtatggacaagatagtgtgccattaagaaaaataccctatattggtaaaattaatgaaaatgaattcatagcttatggttataataaatggggcatgactttgagtcatgtagctagtaaactaatttatgagttgattataaataatgatagtaaacttgctgcattgtatgatcctaattatggtcattatttacattcttacaaagatattattaaattggttaaaaataattatcatggaatgataaagaatcggattttagtatctaaggaagtaaaattaaattgtaatcaagggaaagtagtacgctatcatggacatttaattgcaatctataaagataagcaaggaagagttttctacttttcaccatattgtcctcatttaaaatgtgtagtagaatttaatgaaaaagatcaaatatggcattgtccatgtcatggatctatctttgattgtcatggtcatcttattagtggacctgcaacaagacaattaaagaaatattaaaaacatgagctataaactcatgtttttaattaattatttttgttgtgttcttcttttcttttcaacatatcttgatacgaataaatacaaccacaataactttgacgatacaagtgatatttatcagcaaaacgaacagattttaaatagccattattttttttaaaatcactgaataaaaactttgttttttcttgatcaaatgaagctccgatttcattgatccattggctatttttatgtggtgaaacactcaatactgtagtccaatattcgaatttatttttagaggcataatcaaaagctctagacatccttttttgataacaaagataacaacgtttacctccttcaggttcatctttgtaaatagcaattttttcaagatattctttaggcaaataaggatcttcaataactttgatgtggtgattgaagtccaaattaaattgatcaataaaagtcaataattcttgataacgtcgctgatattcatcattaggatagatgttagaattagaatagtatatggtaatatcaaaaatatcagcaatttctttaataacattaccactgcaagggccacagcatacgtgtaaaagtaatgttggtcttgttccttttattttttgtaattcttcttgaaattttaagtcataatttattttcatgcgctaattatagcatatttggagattaaaattaatgattttaatatttatcatggattttaagtgaaaaattagaaagctattaattatttttaaactaaatccatagtcgtttatcagattcttttaaatcacttattctttgtttaaactgtttataatcattttctttaactaattttctagcgaacttcaataaaatcaatagtatcttataaagctagacaatctatttccttttttgactcgtttgcggctagaatacttatcttttcttttttcattaaactggcttaatgatcttgatcatcatagagcaggaatttgaataagatgtcacattatacagtactagttcttttgatgtttattacatcttatatatagaaatttagtattttactttaaaaaataaaaccaggagtagaaatataatacttctacctctggtatgtataaatttagattataaacatactatcaccaaaactaaagaaacggtatttttcattaattgcttcttgatatgctttaaatataaattcttttgaagcaaaagcactaattaacattaataatgttgattttggtaaatgaaaattagtaattaaacaatcaatagctttatattgatagcctggataaataaaaatatcagtattttcatgggttgctttaaatttgccatacttttgcatgtttgcttctaaagttctagttgaagttgttcccaccgcaatgattctttgcccattaactttagcctgatttaatttatcagcaacttcaggttcgatcatataatattcgctatgcatatgatgttttaaaacattttctacttttacaggtctaaaagttcctaaaccaacatgtaaagttacatcaagaatttcaattcctttagctttgattttttcaataatttcattagtgaaatgtagtcctgccgttggtgccgccgcactaccttcaattttagcgtatacagtttgataacgattttgatcttctaatttttctttgatatagggaggaagcggcattgttcctaattgatctaaaatctcataaaaaattcctgtatagatcattttaaatattctaataccttcatcttttatttcaagacattttgcttttaataaaccatcaccaaaactaataatagtcccgattttaacgattctagcatttccgactaaacattgccaaatatcatcaccttggtcctttaataacaaaacttcaacatgaccattagtttcttctttgatgccaaataaacgtgccggaataactttagtattgtttcttactagaatatcacctggttttaaataatcaatgatgtcataaaaatgcttatgttctattgtttgtttttcgcgattcaagatcatcaatcttgaggtatcccgcttgtctaacggtgtttgggcaatcagttcttctggtagttcaaaatcaaattcacttagtttcattttaaaaggccctcttatagacatcatgaccgtatttatttagaaactcttctttaaaatcaagcaagcggtcttcttttatagcttctcgaatatctttagcgagttctaataagaaattaacattatgaatagataataacgtttttccaaatatttcatcacatttatgtaaatgacgaacataagcttttgtataatttttacaagtataacaattacaattagaatcaagtggtgaaaaatcatatttaaatttttcattattgatattaattcgtcccatacttgtcataactgcaccatgacgagcgactcttgttggtaaaacacaatcatacatatcaattcctcttattgcacattcaattaaatcgataggattaccgactcccattaaataacgcggtttatcttcaggcaaccatttaattgcatcatcgaccattttatacataacatctttaggttcaccgacacttgtaccaccaatcgaatatccagggaaatccattttaactagttctttagcacatcgttctcttaaatcagaaaattcgccaccctgcacaattccaaaaagagcttgtttatcagtgtttttatgggcctctttaccacgcttagcccatcttaaggttctttccatactatctttcatatattcataagtgcatggatatggagcacattcatcaaatgacataatgatatcagctcctaatttattttgaatttcaattgctttttctggagaaagaaaaagcgcccttccatcaataatgcttttaaatttaactccctcttcttcgattttacgggtatttcctaatgaaaatacttgaaaaccaccactatccgtaagcattggtccatcataattcataaatttatgtaaaccgccagcttgttcaactacatcttcacctggtcgaagccaaagatgataagtattggcaagaatcacttgtgaatgcatttctttcaacatttctggggaaattccttttacagtagctaacgtcccaaccggcataaacattggtgtttcaacatcaccatgaggagtatgtaagattccatagcgggcacctgattgtttacaaacatgttttaattcataacttattgctgccataattgtcctccttaaagcaagcattattataccttaatcttattacaaatacaatttttgtttaaaaaataaaccagtttgtttaaactggtttaaatcaattttaaatgctctaaagcgtgataaataccatcatcttcaatatctttagtaacataataagcatatttaaataattctggatcaccatttcccattacaatcgcatgcttaacataacctagcattggttcatcattaaaactgtctccaaaaacataggcatcatctttttctaaattaaaataatctaataaaaattgaattcctgttgctttagaataacctttaggcactatttcaccaaaatttttatctctagtaatataatcaaaatcatcagcaatgctttctttaaaagtattaatatcactatcttcatcaaaccagatagtaagtttatcaaaagataatttaggatcgtcaaaagttgatagtgtgaattcaggggtattttgatagcgttgttttatctcttttactaatggatggcgaatatgctgatcaaaatatattgaatcagttccttctaataccccatcaatattagtttttctaactaattcttttatctcattacatcgtttagatgataatgtaaaagaagataagactttatcatggtaacgaatatatgttccacaaccacaaacataaccatcagggtctagatcttttatgcagttatcaatcagtgaaaatgttctgcctgtgtttataaaaataagatgcccgttttcttttgcttttttcaaagctgtgatcgtactttctggaatcgaatgggttttttcagataacaaagtaccgtcaatatcaaaaaacataattttattattcataactacctccaatgtcattattatataataataaaatagaaattattagtttttatcaaaaatagaaaatttttgttttatgtaaaaataataaagtataaatttagaataaataagttaacttgtaggatttatgttgatttttatgtcgatacaatattatattgcctatagttattaatattgcatgtttagattaaaacgcttaatatttagtttatgtatgattttaatacccaactttgattaaagggaatattgtatacaaaaaaagcggattttcattgtttttttttgttaagcaagctacaataagtaggtataaataatgtagggggaataaatatgtacaagattttgaaaaaagaagtactgaacgatgtggtagaactgatggaagttcatgcaccttatgttgcaagaaaatgtgaacctgggcaatttatcatcttacgagtaggcgaagatggtgaaagaattccattaacaattgccgattttgatcgcgaaaaagaaacaattacaattatttatcaaattgttggatattcaacaagagaattggctaagttaaatgcaggtgacgaattaacagatttcgtcggaccattaggagtgccaacaaaatttcatgaagctaaacatgtaattggtgtggctggcggtgttggtagtgcaccattatacccacaacttcgtgagctggcaaatcgtggggtagatgttgatgtgattattggtggacgtgaagcacaatatgttttacttgccgatgagtttagaaaattttgtaaaaatgtctatatcgctactgatgatggatctttagggactaagggatttgtcactacagtattaagtgatttaattgaaaaaggtgaaagttttgatgaagtaattgcgattggtccagtaccaatgatgaaggctgttgttaatgtaacaaagccaaaaaatattaaaacatcagtatcattaaatccaatcatgatagatggtacaggaatgtgcggctgctgtcgtgttagtgttgatggtaaaattaaatttgcttgtgtagatggaccagattttgatggtttacaggttgattttgatgaattgatgatgcgccaaagaatgtttaaagaagaagaacatacagttaacgaaaatgcgaaccggatgtgtaatttaatgggaggtgcaaaataatgccaaatatgtcattgaccaaggttgtaatgcctgaacaagaaccaaatgtaagaaataaaaattttgatgaagttgcgttaggatatacgaaagaaatggcaatggaagaagcaacacgctgtttaaactgtaagcatcagccatgtaaaaaaggatgtcctgttggagtaccgatccccgaatttattcagcaggttgcagctggtgattttgaagaagcttataaaataattactagtgaaaatgctttgccggcaatttgcggacgagtttgtcctcaagaaaatcaatgtgaaggtaaatgtgtacgaggaattaaaggagaagcagtaggaattggacgacttgaaagatttgttgctgattatcatatggctaatggtaaagcgccagaattaaaaattgaaagcaatgggaaaaaagttgctatcattggttctgggccagcgggaattacatgtgctggagaattggctaaaaaaggatatgatgtaacggtatttgaagctttgcataaaaccggtggtgttttatcatatggaattccagaattccgtttgccaaaatctttagttcaaaaggaagttgataatgtttcggctttaggtgttaaatttgaaactaatgtagttgtaggacgttcaattacaattgatgagcttcaagaacaaggatatcaaggaatttttattgggagtggggcagggttgccacgattccagaatattcctggtgaaaacttgaatggtgtttatgctgctaatgaatttttaacgagagttaatttaatgaaaggttatgaattccctgatcatccgacaccagttaaaattaccgatacagtatgtgttatcggagctggaaatgttgcgatggatgcggctagaacagctaaacgtttaggggctaaaaatgtttatattgtgtatcgtcgaggagctgaagaagttccagcccgtgcagaagaagtacatcacgcaaaagaagaaggaattattttcaaattattaacaaatcctgttaagatcgaaggagaagatggctgggttaaatcaatggaatgtgttgagatggaacttggagaacctgatgaaagtggcagaagaagaccagtagtaaaagaaggttcaaactttacgatcgaaacaggtacagtaatcgtttcaattggtcagagtccaaatccgttgattagacaaacgacaccagggctagacactcaaaaatggggtggaatcattgttgatgaagaatcaatgaaaaccagcaaagaaggtgtctatgctggtggtgatgttgttactggagcggccactgtaattcttgctatgggggctggtaaaacagcagctaaagcaatggatgaatatcttcgtgataaataaggatagaatctataaggatgaaaaaagtgttttactggttttagtaaaacacttttattatgtttagaaagttagagttgttaattacgatcttcttcatatttaataatttctccgctaatagcatcgatatcgatttcgtattcaatattaccgtttttaatttctatttcatatttttggataccatcatctatgtccaattcacattttactaagtatccattattaccaactttttccattgcaattctttgggcttcatcaatgctaatggttgtcgcttgagaattgttattttgagatgcttcattagaactaggaacatagtcagtatctttttcatttttaattattttgccagtattagcatcaacttcaatttcatatttttgattatcactaatgatttcaaaatcatagtaatcaataccatcatcacgctctttcttggctttggtaactttgccgtcaatagctttcaatgcaatttcctgtgcttcatctaaagaaatagcttctaccgaactatttgtacatcctgttaaaattattgtaataaataagatagtcattaattttttcataagtcattctcctttaaattgattgtaaattctgtatattcattaattttactgataacattaatttgataaccataataatcacataatcttttagcgatagctaaacctaaaccaaagctgttattgttttgaactcttgattcatcaactttataaaaacgattaaaaatatgatctattttatctttatcgatcccaatcccataatctttaattttaagctgattttctaaatactggatttcaattctgatttcattatgtttagagtattttacagcattatctattaaaattattaataactgttttaaatgctcttcattaattttgatttcttgatgggaatcgatcgtgactgtaaaaatgatattagggtttaattttttgaaatcttcaactgtatcataaataatgggaacaatatcaatttttttatcacacttaacttttatttctctagttaaatgtaataattcattgcataatgtaactaaacgatcaacttctttactagagacttctagcgctgatgataaaacctttggatcatcttttccccagcgtctcaacatatctagatttcctttaatgatagctaaaggtgtttttaattcatgagatgcgtcgctaacaaattgactttgttgatttaaagaattttcaagctgatctaaaacatcattaaattcttttcctaactgtccgagttcgtcgttgttatctatttgtagacggtgttttaaaccttccttttttatctgttgaatactatttgtaaatttttttacagtttttaaatatcgatcactgattgttatgccacagataatactagttattagtgctactatagttagaatgatcaacaagataataatgatactggcaattggagtcattactgcttcatccatagcatagattttactaatgatcaaaagataataagacatatatataagcaagatcaaactgaaaaaactgataaagatcataatgatcaatgaagtagagaaagttaattgaaagcgaaaagagtgattttttttcatattaaacgatatccgattccgcgaattgtttcaattttaatatccggcagtttgtttcttagatagcggatataaacttctacgacatttgttgaaacacttttttcatagccccatacttcatttaaaatttcgtctcttgtaacaatattgccattatttttaattaataatactaataaatcaaattctgttgtagtaagtgaaacttcttttttcataaataatacttgatgttttataacatcaacttcaagatctttgtgtttatatttaagaacattactttggatttttatccgtctaagtaatgcgttgattcttgccaataactcttctattgcaaaaggttttgcaagataatcatcagcaccagcttgaagaccgttaactttatcaattacttcatcgcgagctgttaacataatgattggtgtttgtttttctaggcggatacgtcgacatacctcaatgccgttgattcttggtaacattaaatcaaggaggatcagttcataatcctggttaagagctttgatcagaccagtttcaccatcaaaagcttgatcgcataaataatttgcatgtgtaagttctagttttaaaagatctgacatgtttttttcgtcttcgataattaaaatcatttattattcctccttgtattcatagcttgtaatggttccatctttagcgtcaataattacttcgattatttcttgattagaatttttgatttttaattcataataagtttgaagattttcgtattcaatatttgatgagataattgttcccggaaatctatttagagcaattacatgagcttgattttttgaatattcaatgttttgtaacgtcacatggaggatataaataccaaatattataatcatcagaattattatggaaatagtcaaaattatttgttttttatactttagaaatgtttgcatctttatttcctcctcatgtatataataccttaatttttaatttgatgccttaaagtttgataataaataaataagaattttctcatatttcttgttataatggaaggggtggtaattatgaaagtattgattatatactgtcatcctagtaataatagttttacttcaagggtgagagatgaatttattaaaggattaaagataagtaatcatgaatattgtttattagatctatatgatttgaattttaaagaaacgtttagtgaggcagagtatttaagagaagcattttataatgataaattagatatccctgaagatgtgaaaaaacaccagcagctgattaatgaaagtgatgccttagtatttatttatccggttttttggactgaagcaccaagtaagttagtgggctggttccagcgggtttggacttatggttttgcttatggcagcaaagcaaaaatgaaacagctggacaaagtattgatgttagtgacaatgggtggcgatttaacggaaaaacttcgtcaaaaacaggtggaagcaatgaaaaccgtaatgctgggggatcgcattaatgatcgtgctaaagaaaaagaaatggttatttttgatcggatgtcgcgagattatcctaatcgtgaagctaattatgaaaaaaatttaaaacgtgcatatcaaatagggaaggagttttaaaaatgtatgtagaaagaattaaagattcactagaaacaccaagattaaggttaagaaagtttaagcgtagtgactgggaagctgtttataaatatggaagtgatcctagagtgctaaaatatcttgaatgggctggagtaacaactaaacaagaagcgatgagtagtattgatgattattatttgagtcgtgccggtatttatgcaattgttttaaaggatactgatttatgtattggagcaatagatattagacttgatgaagctaatgataaagcaggttttggatatttgttagatcatgattattggaataaaggctatatgagcgaagttttgacgaaaatattggaacattgttttgtggatttgaaactaaatcgagttgaagcactgcattataaaattaacgaagcttctggtagagtaatggcaaaatgtggaatgaaatttgagggaatcggaattcaggaattaaaggtaaaaggtgtttatcaggatgctgttcactatggaataactaaagaaatgtggcaaaatcaatgatttggtcattacaactccaagttgctaaaaaattgataaaggcaatggcttgttggtagtaataaaatctttgctcatttaagatatgcatgaggtgataaaaatgggtttaagtaataatttaaaaaaggggttatctcaagaacagttagccaaacagttaaacatatcgcgacaggcagtatctaaatgggaaatgatagtggtttaccagaagtggaaacgttgatttctttaatcgaaatatttggctgtacaatagatgatttattaaattatgattctaccagtaaacaagaatatgaaaaacattataatttaatggctaaggcatatacttttggcacagtttttattttactaggaatttgtgtatctctatttacagggatttatttcccggaaaatactaaatacgagtttgtttgccaaattttactatcattctttgttttgataggggtaatatgctttgtttattttggaatgatagacgcacattttaaaaagcaaaaaaatgaattaaaggatttttatagtgaaaatgaacagagtaagtttgaacaaaaatattcattagtcacaactataggagtagggataattattgtgcaaatattagttgaaaatatttataatgaaaacttggctactgctttattcatgattttaataacggtagctgtggggatatttgtatactttggtacgcttaaaaacaagtatgatctggctgatttttgaagaagagaattaatagaagaaattattttagtattattacaatgataatttattggttaaaaactatattttttattatcatgataaaaaatgctactaatttatttagaattcgtgtataattgcagtaaagaggagtgattaataaaaatgtataaatatttggaaccatatgctgcaatgacagaatttttaggtaaagctttaggtgataatgtagaaatagctttacacgatttaacttctaaagaacaagaaatagttgcaattgcaaataatcataattctggaagagaaatcggtgctaaattatcaaatttatcattgcactatttggaagaaaaacaatacttagatcatgattatgtattgaactataaaacaactggacctgatggtaaattaatgcgttcagcaacatattttatcaaagaaaatggtaaagaaatgccagtagggatgttatgtgttaatgtaaatatttctgatttagagtatttgacatcgacgattaaaaagatcttaggaatcaaagatgaaaaagatattgaatttagaatggataatccagttgaaatcttatcttctcctttagatgagatgatcgatatgtatataaaagaatgtttggagaagatgggattcccaagttattttttagctgaacgtttaaatgttgatgaaaaaataaaagttgttaagtatttacaagaaaaaggaacttttaaagtgaaaggtgctattgtgctagttgcagaaaagttagctgtttcagaaccaacagtatatcgttatttaaaaaagatggaaaaataggaggttaaaatgaaagaattagtttatgtaagtggtcatagaaatccagatacagattctatctgttcagcgattggatatgcgtatttattgaaagcaatcaaccgttataatgcagttcccgttagacttggtgagattagtcgggaaacggagtatgttttaaaaagatttaatgtagaaattccggtactgcttaaaacagttaaacaaaaagttgaagatttaaattatgataaagtaactgttttttctaaagaattaacattaaaaactgcatggtcattgatgaagcagcaaaatgtgaaatcagcaccaatcttagatgatcatggccagttattaggtctattatcaacttctaatattgttgaaggttatatggaaaaatgggatagtagtttattaaaagatgctcatacgccaattgaaaatgttattgatactttagaagcatcagtcctttatctaaatcgtgatttaagatttatagaaggtgacttacatattgcggcaatgcgtggtgaagaagctaaaaagcgggttaagccaggtgatattatcattattggtggagatcgtgatgatgctgttaattctatgattgatgctgaagtttcgttgatcattttaactgggtctttggatgtagaaacagaagtcttggaaagattaaaggaaaaaggaattagtgttatctcgacaccatttaatacatatttaacatcacagcaaattattcaggcaattccagttgaatatattatgcaaaaaggtgatttgaagttatttacaactgatgatactttagatcatgttaaagaagtgatgagtgaaacgagatatcgaagctatccagtattagatttaaataatcgttgtgttggaagtatttcgcgttttgcgttattaaagggcttaagaaaaaaagttgttttagttgatcataatgaaagaggacagtcaattccaggtattgaagaagcggatattttagaaatcgttgatcatcatagggtagcggatatccaaacgattggaccattattgtttagaggtgaacctttaggatcaacagctacgatcgtaacaaagatttttgaagaaaatgacattgaaattccgcaatcaattgcaggaatattattgggtgctgtgatttctgatactttgttattcaaatcacctacatgcactcctgttgatactaaaacagcacgcaaattagctaaaattgctggtgttgaaattgaagaatttgctatggaaatgttcaaagcaggtacttcattagttggtaaaacagtagaagaaatttttaatcaagattttaaaaagttcccatttgaagaaggaactgtcggagtggctcaggttaattcaatggatattgaaggattcttgccatataaagaagatatgttgaattatatgaataaatttgcggaagataataacttggatttcacattattattgttgacagatattattaatgcaaatagtgaaatttttgttgccggacctaaacctcaattagtggaacaggcatttgacatctctctaactgattatcaggcaacattaaaaggagttatttctcgtaaaaaacaagtggttccagcgattactgcggtgatgagtaaataagatgagattagataaatttttgaaagtttcaagaattattaaaaggagaacattatctaaagaaataagtgaaagttcaagagtcaaggttaatggaaaagtcgctaaacctagtacaagacttaaagttggcgatgaaattgaaattgaatttggtcgtagtttattaactattaaagttaaagagttacgggaacatgtgttaaaagaagatagtgcgatgctttatgaaataattaaagaggaaagaattgatcggaataataaagctgctgataaataatcagtagctttattgatttaaatgtggaatttattgaagattcaataatataacagtttttacattcgttatgattgagaatttattgaaattggtatactatatatacaaagttgaaaggagatttatatgtacgcaaaaaatgcatgggaaaaatataatgaaacgcaaattaaagaaataatgaattttaatgaaggatacaaggactttatcacaaaaggaaaaacagaaagattatgtgttaaagaagctgttaaaaaagcgatggcagctggatataaagatttaaatgatgttgatattttaaaacctggggataaagtatatgttactaatatgaataaaaatattgctttatttgtgattggtaaacaatcaattgaaaatggtcttagaatcttaggagcacatattgattcaccaagattagatttaaaacaaaatccattatatgaaagtgagggatttgctttattagatactcattattatggtggagtaaagaaatatcaatgggtgacaattcctttatcaatgattggggttgtggtgaaaaaagatgggactgtgataaatgtaaatatcggtgaggatgaaaatgacccagttgtaggaattagtgatttattgattcacttatcagctgatcagttaaaaaaagaagcagcaaaagtaattgaaggagaagatttggatgttacttttgcaagtatgccactaaaagatacagaaaaagatgctgtaaaagctaatgttttaaatattttaaaagaaaaatatgattttgaagaagaggattttttaagtgcagaaattgaaatcgtacctagcggaaaagctcgtgactatggaatcgatcgtagtatggtcgctggatatggacatgatgaccgtgtttgtgcttatacatcattaatggcaattttagatatggatatcccagaatatactagctgtgctattttagtggataaagaagaaattggtagcgttggagcaaccggggcacactcattattttttgaaaatataattagtgaattgttatctaagcaaggtgttgatagttttgtaaaaacaagaaaagcgttagctaattcaaaaatgttgtctagtgatgttagtgctggtgtagatcctttgtatttgagtgttaatgataagaaaaatgcagcttatttaggaagaggaatagtttttaataaatatactggatctcgtgggaaaagtggttctaatgatgctaatccagaatatatggcacagattagaaatgttcttgatgaagctaatgtttattatcaaactgcagaacttggtaaggttgaccaaggtggtggaggtacgattgcttatattttaggtaactataatatgaatgtaatcgatgctggagtagcggtattgaatatgcatgctccaatggaaattgttagtaaagtagatgtctacgaagcttatttagcttatcgtacgtttttacaaaaaatttaattaatagaccgttaataaaatatttattaacggttttatttttttatttaatttatagaaagtaaattattatggaaagtaaccagaatatatgttgatatattaatatattcctcattatttactttccataatattatttatttaaatctatccagtatagaagtaattactaaatcatcttgtttaatttcattctttttatttaattcaagtttgtcagtacgctctattattgctttttgtaatatattaatattagttcttacgtacatttcagtggtttgtactgattcatgaccaagaaaatcacggatataatatatatttatatcacattccaatagatgtgtagcttttgatcttctcaaaatatgtggagttatagttccttgaaaaaaatctttattttcttttcgacattcattagtatatttattaattatatatgtaattcctggtcttgtaagtttttttaaacgtgaattcataaacagataatcattattctgcaaatcgaaagctctaatgtactttaagataattgagtttacatttgatgatataggtatttctctttgttttctacctttacctaacagtgagatagtatttcgtttaaaatcaatatcctttacctttatttctataaattcactaacgcgacaaccactatcatatagtaaacttattaaagccacatctcttatacctttttttgtggtcgtatcaggttttgatagtaaaagttttatatctttcatttctatatatctcttttgtttttttatttcttttttaaatttaattttcaaaatatcagtacattgatccagatattcaatattttgatttataatatagtcacataatgtatgaataactgctaaacgtaaatttcttgttctgatagaattttttttataatcttcaagccaattaagatatttgatgacaatttctttttttaagtgacataaagttatatttttttctaggataccaatactttttaaatattcaataaaagtctgtaacgagtatgcatatgtttcgattgtattttcactgacacctctttgctttcttaaataatcagtaaaaaatctactgataagttctgaaaatctactatgtttcattttctttcacctttggaaacaattcatttattacagatatatgagacatatcattaaatttataatatggaagatgaatatagacttctgtttcggtaattttctcatgtccaagtaaacaagataataaataaatatcttggttgacatttataccattactgatcattttttcaatcatatgtactgctgcagtatgtcttaatgtatgcaaactcattttcttattggtaagattttcattatatccaattttttttatgatttttttataatgataataaacaacttctttggtcaaaggcttagaattatcaagttgaaaatataatttattcacaaaaaatacttcattttgatatttttctaagcatttgcacatactttcacttagagggacatagcgacatttattattttttgcatctttaataaatatatatttttttgtaagatttatattttctcttttcaaattcaaagtttcagatatgcgtaatccacaagaacaaagtaatcttataatcaatggcattgttttcttgatatatggtttcaaattttggttattttgacaataattatcgactgctctgattacattataaatttcttcattatcaaaaatatatggattaaactgccgtttccttgcaggtaacgatttctttggtataacatatgcttttttacccatttttacgagatataacccaaattgtcttagtagactggcataggtatatttttgatttgcttctttttttgaaatgatatattctacacattttttcgaaagaactgtatcatctgataattgatgtaattcttgaaactctaaaatcatacaatcaatatgcttcaactgatataatattgctccactatatgaatatcccaaagatcttttataggtaataaattttcgaagttcataatttgatatattatttaactttatttcattcataaaccggcacctccaaagctaaaaacctcaaagtttcaacactaattttagaataagcttttgtactttcagatgtagcatgtcctaatatattagctattgttgtgtttgttttcccattattaattagctgatgtgccaacgagtgtcttagtacatgtgagtaagactttctattttttaaattaattccagattctaggaatgcttcatgaactattgctgtaattctcatttttgaaagctttccttttaatccgttttttggtaaatgagtaaataaatatggtgacgatgtatctgttcgtatttttaaatagtctagtattgcatgttttaattcataaggaatataaagtttgacttctctatatgttttgctttgtacaaatattacacagttgtcattccaatggatatctttaatttttaataaagaaatatcaactgctcttataccgagtaatgagcataaaagtactatcgcatattttcgttttcctgcttcatgatctctattgatagaattgataatacaactgatttcactgtctgtataaaaatcaggaagttgtgtgtttttataggatttaattccataaagcaataacgaataattttgatcgatccaattttcatcataagcatattttaatataagtctcaatttacaaatgagatcatgaacagaaactggtttaagaaatttttttgtaaattcaagataactgattatgatattttgtgtaatcttatccaaagaaaaaatattattaaaatatagataaagaagaaaacgtaaaagataagatttaatagtgctgacagcatttatactatgtgattgttcccaatttttcaaaaattgaaaggaaaaatcaataagattgtttgcttgattattaaattgattatgcatatccaattcatagaagtcatcaataatagaaataactcgcagatatttactccttacatcaaattttccattaaaataaagggactttataaataaaaatagagaatttgaagtgatgtagttaaggttcatgttttcatggaaatttaatatagcttttaatacaatgcaataatttgaaaagcgtggatttcgaatttttaaatgtttcagataagaactaatttctggaaaaacatgtagtaataaaacagactttgataatttatcatgcataaatatgcacctccttcaaagtctaattaccataaatattatggaaagtaaataatgaggaatatattaatatatcaatatatattctggttactttccataataatttactttctataaattagattatggaaatctttccataatttaataagaatttggatttatctggtgaagctggtataaaataaattttgatcttttttattatttataaattactatacaaatttttcattatagaatatatgattttaataagtaaaataggataataaaaaataaaaatgtttactaaaattattatttaggttataatgggtagcctagagataaaatatgaaaaaatgattaaaaaatgctgacaaaaagatgattatttagcttgttcattaacaatgatgcaagaggatatgaataaaatattttcatattattatttctagaaatagagaatattaataatctgtatagtcattgaaacatttaagatgatttttatttatttaacgataaagcggctagtaatataaaaaagattgtttttaatggtagttataaaaatttgctttaaaataagaagtttttaaattttgttatttatgatataatcgatactaaggcggtgattaaattgatgattgaaattgttgattataatgagaagtggccgttaaaatatgctgcagaagctaatgatattcgtaatattatctcaagtaatttagtctctatttatcatattggctctactgcaataaaaggattaaaagctagagcggttatcgatgttttaattgtcgttaaaaaaatagaagtgatagatgaactaaaaaaacagtttgaaaagttgaattatgtttgttgtaaagacgaattggatagatattgttttaaaaagaatgatggtagtttttgtttatatgtattttcagttgaagatgttaaagagattgaaaaatatttagctatttctctttatttaaaagaacattcagaagtagcatctgaatacactgatttaaaaatgaagattgctaataaatatcgtaatgataaaaaatatattaaagaaaaaaataagtttattactaaaatagaaaacgatgcttgcaactggtatcaaagtaaaaatattcatgttgtatagtggttcttatttaaagattttttcatattattaactggaggtaataatatggaaaataataatatacgttttgaacatactccttatcataatgtttatttgaaagatcggaagaatattgaattaacaggtgttaaaaatattgaaagttttgattcattagaatttttgattgaaacatcactaggttttttgaatataacgggtagcgagctttctctaacaagacttgatcaggaaaaaagtgaagttagtattaaaggaaatatcgattcgatatcctatgtatcaaataaaaagggacctaaatctaaagaaagtgtttttaataaattacttaaataatggatctaattagacagattcagggaattggttattcacttgtttatggatttgtgtttacttttgtttacagtcttatcaatcgtttgctttataaataccaccaatgcattattagactttttttacagattattattggtattatttttgggtatatttattatcttggtttgttaagaatcaataatggtgtaattaggatatatttctttgttagtatgttgattggatatatattgtatcttaactactatagctactatatgtttattttgattgaattgattgtaaaaatgattaaatatattttaagaccgataatatttctttttagaaaagttaatggtataataaagcgggtaaagagggtgatgagatggccaaaagaaaagttttcaaaacagtcaaaggattcttgtacatgattattggatgcggattattgttgacgttgtttaatagtatggtaacggtctatcagcatcaagatgaaatagccatattgaaaaaggaaaaagcggctgttactaaagaaaaaaaagcattagaaaatgaaatagatttattgaatgatgaggattatgtgactcgttatgctcgtgaaaattatgtttttacacgtgatggagaacaggtttcgattattcccggagttaaataataagcacatagtgcttatttttgttatggaggtaataaagatgtttattgaaaaaaatttttatatgaagtcattgagacggatgcgaaaagttacgatctatgttcctgatgattatcaaactagtaacaagcgttatccggttttatacataaacgatggtcaaaatgctttttttgatgataaggcatatatgggaattagctggggcttttatgattatgtaaaatcagttggtttagatgttattatggtggcgattccatgcaattttcatttaaataaacgcgaagacgaatatggcccatggccgattggtaaagatattttagaaatggaatacggtgatgatagtttgaaaattggtggtgagggtaaaagatatttgcagtttattataaaacagctaaaaccgtatatcgatagtcattttccaactcttaaagatgattgtgcaatggtaggcagttcaatgggaggaatcatcactagttatgcggggataaaatatagtcatatttttaaaaagactgcgtctctttcaactgcatactggttttatgtcgatcaattttgtgaattgattgataaaagtgatttaagtcaagttgaatgtttttattttgatttaggtggagatgaaggaaatggtaataaaatggtaagccagatttattatggaagtaatgagatcatttatcaaaagatgattaggaagtgtgataaagttgaagtccgattttttgaaggtgctagtcacaatgaggaagaatggcgtaaaagagtaccaatatttatggaattgttttatggataaaaaaggtgatcatttgatattataaagcgaggttaagtatgtataggctgatgttgtcagatttggatgaaactttactagtaaatcatcatgttccggattttaatattgaagcaataaaaaaagctcgtgctaaaggtttgaagtttgtaccggcaacgggaagagcatataatatgattttagatattttaaaagaaattggaacttatgatcaagctgatgaatattcaatttgttttaatggtggattaataattgaaaataaaaataatcgtattttaaattttaaaggtctttcttttgaaagtgcaaagttgttgtttgataaagccagaaattatgatgtttgtattttggtttttacattggatatgtgctacatatataatgctaatgatgatgaagtaaaacgaaagactgatcaaaaagcaccatttatagtagtggatgattataattttgagatatttaaagataaacaaatagctaaaattttatatcagaaaaaagatatgaaatatttaaaaatgattgctcatgaattaaatgaatttactaaggatcaaatagctgttagttattcatcaaatcgttatctagagtttaatgctttaggagtaaacaagggttacggtttaaggtggttggctgattacctgggaatagatttaaatgaaacaattgctattggtgataattataatgacgtcgaaatgataaaaacagcagctttggggatatgtgttgcatgtggtgataatgaaattaaagaattagcacaatatgttacaaaaagtgattattatcaaggagcggttaaagaagttattgaaaaatttgtattggaggaaaaataatgggttataaattaattgtttctgacttagatgaaacactattaaatgatgaccatcatgttggtcaaagaaatcaaaatgtcattttaaaagcgcgaaaagaacatggaattaaatttgttccagcgacaggtcgaggctttatgcaaattcaaacggaactaaaggaattggaattaaatgatttggaaaatgaatatgttatttcctttaatggcggggcattaactgaaaataaagataatcgacttattgaatttaaagggttaccctttgcaaaggtgaaagaaatatttgaagcaggattaaattataatgtttgccagcatatttatactccggatactgtatatgtttttaatttgagtgattcagagaaaaaacgccttgctaaacttaagtttgaaattgtttattgtcaagaaaatagcattgattttttaaaggatattccgattgctaagattctttatcaaaatgatgatgtgccatatttgatgagtttagaaaaaccattggaaccgattatcgcaaattgcgtagaagtgagctattcatcaaatcgttatatggaatttaatgctttaggagtaaataaaggacaagggttgattgatttagcgaataaattaggtattgatattaaagatacgattgcagttggtgataattataatgatatttcaatgttgaaagtggcaggattagcagtagccgctaataatgctgttgatgatgttaaagagatatgcgattatgttactaaagctgactgtaatgaaggggttgtagcagagttgattgagaggtttatttataatgagatttaaagatattgtagctgttgaatttgaacaagagtattataaaaaattacatcgttttgttgaaaatgaatatttacataaaacaatatttccacctcgtcaaaatattttcagagctttaaatctttgcgattatgaagatgttaaagtagttattttaggacaagatccatatcatgaattacatcaggcaaatggactggcgtttagtgtttatccaggtgttagaattcccccaagtttaattaatatatacaaggagctaagtgatgatgtccatactaccatgcctaataatggtgatttaaccaaatgggctaaacaaggcgttttattgcttaataatgtactgacagttgagcagggaaaagccaatagtcatgctggtattggttgggagacttttactttgaatatagtaaaggccttaaataaaagagaaaaaccaatggtatttattttatggggaagtaatgctcgtagtaagaaacaatatattgatacaactaaacatttagttttggaaagcgcacatccttcaccactttctgctcatcgaggtttttttggctctagaccgtttagtaaaactaatgaatttttaattagaaataatatgactccaattgattggcagattgataatgtttgataatattaaagaagctgttgattatatcgaatcaaaaagagttaagcgttcatttgaacagtttcaagaaattgttaataaatatcattttaatcttcatcaaaaaaatatgattcatgttgcgggaactaatggtaaaggatcaacaacaaattttattaaagaaatattgatgaaacatggatatactgtaggaacgtttacctcgccatatatgcttgttcataatgatcgtatttgtattaatggtgagatgattagcgattctaaattacttgaaatcatcaatggattaattgatattattgaaattgaaaaattatcgatgtttgaaatagatgtgctaataatgttgcgttattttaatgaatgtgatttagattatcgaatcattgaaactggtattggtggtttaaatgataaaacaaatgttatcgatagtatttgtagtgttattactaatattggttatgaccatcaatttatgttaggtgatactttagaggaaattgctttacaaaaagcgggaattattaaaacttgtaaaccgtgttatatagtaaaacaaagaaatcagataaatgatatttttaatcgggtttgtgaaataaataacagtaaattacatattgttgaaattgataatattactaaatatccttatgtatttaattgtttagatcatatttataaattagaaaactgtggtagttatcaaattaataatgcatctcttgcaattaccgtatgtaatgatttaattgaattagataatgatttggtacaagtagctttagatgattttagctggccgggaagatttgaacgttttgggaatatttatttagatggtgctcacaacattgatggaattttggctttgattcaaacgttaaaagatcagaagttagaagatgtagtgattgtgtttagtgctttaggtgataaagatattagtgaaatgttggaactgctaaaggattatcctataattcaagcaagttttgaagatgaacgcttaaaatcagatgctttggattttaaagatgttttagtacaggtagaaaaaaagtataaaaatattgttgttacaggatcactgcattttattagtgcagtacgaaaatatttaaaaaattgagaaaatgacataaaaataagagatttcaaaattactacatttattatgagtagtgttagaaatctctttttatatttgttctatagtaagaaagaactataatagttttcaatttatgagatatgatagtttttattgagaagagaattgatactctatcttttcgccaaattctgaccatagtaagtagacgtaaggtaacaagaagcgcttttcgctatttggatctttgataataaaataatcacgtcctgcatcttcgattatacctacataacttttatcgcgccatttattactgccgctaaaagtaaaataaaaagtacctaacttacctgtatttaatttaataatgtttcctaaatatacttgcccgatggcaccgggattaacaggtggtgttcctggggtttgggtaggaggagtttcattttcttgtcttactaaataggggtttaaatcatcaaaatagtccataatatctatcctttcaatgaaaaaattattgtagatttaaatgttagctaaaatagtgataataatttaactaccgatagggataatgtagatctagttcttcatcaaactcgctccataataaataaagagaatttaggacaaaataatcgtcactgttcggagctttgattatgaagtaattacgtccaacgtctacaattattccaacgtaaattttatcaggccatttaatactatcgctaaaggtaaaataaaaagtacctaatttaccagtgtttaattttagaatattagctaagtatgcttgcctaatagtaccaggattagtaggtggcatctcatttgaagggggttgttcatcttgcctcactaaataagggtttaagtcatcaaaatagtccataatatctctcctttataaatcacaatttaaatcttcgttagggtcgtaaaaacagtggttttgaaaacgacctgaaagatatccataaaatctttcggggcattctacattagtgccgggatttttaaaccataatgaataagttgcaggataatttcgataaccttgtattgttcttagagctaattccttttctttagtattaacgggtccgttaaataaaggtgtatcaactcctgcaaaagcatttttttgatatacagcttctgtaatggtaacaacatttctaaagacatcacataccgcagcaacacgattgacgacaacattgcctactaaaagcattccttcttcaccttcacctaaagcctcagatttaattaaacgagctagtaattcgatttcactgtcgttgtaagctattcgcgccattttttcacctctatacatctatattattgaataaaatttttatgataattttttatgaaaattgatttattatattgttttataaaaaaatattttagagtataatatatgacaagatatataattatattttgtgataattaaactcgaatttatttctaaattgtgatagaattaaattatggttaaagcgcttacattcagacaaggaggtatttgaaatgggaagagagattgtcgcaatgattttagctggaggaagaggtactcgtttagaggcattaacagctaaagttgctaaaccagcagttcattttggaggaaagtatcgtattatagatttccctttaagtaactgtgctaattcggggattgatattgttggtgtgttaacacaatatgaatctgttttattaggtacttatgttggtgccggaacaaaatgggggcttgatggtaaacagtcattagctgctattttaccagctcgtgaaagaggggaagtaggagctacctggtatgctggaacagctgatgctatttatcaaaatattagttttcttgatcagtatgatcctgaatatgttttgattttatcaggtgaccatatttataagatggattatgataaaatgcttacagctcataaacagcgaaaagctgacgcaactattgctgtattaaatgtatcattaaaagaagcaagtcgttttggaattatgaatactaacgaagatggaagtatatatgagtttgaagaaaaaccagaaaaaccaaaatcaacattagcttctatgggaatttatatttttacttataaacaattaagaaaatatttaattgccgatgctaaaaaagcagatagtaaacatgattttggtatgaatattattccggatatgttaaatgataacaaaaaattatttgcatatgaatttgaaggatactggaaagatgttggaactgtagaaagcttatggcaagctaacatggatctattaaaagataaagaattggatctttataatattagaaaagaatggaagatctatacagaagatacattaggtaaaccacaaatcattggtgataaagctgaagttaaaaattctttaattacccaaggatgtttagtaaatggtaaagttgaaggatcagttttatttaataatgttaatgttggtgaaggtgctaaagtaatagattctgtattaatgccaggtgtattggtagaagagggtgccgaagtatacaaagccattgttgatgaaggcgttgtgattagagctaagagtaaaattaatgaagaagcaaagaaagtcgctttaataagtgataataataagtaggggaggaagatagaaatggcaaaagcaataggattggttaatctacattcagatgtggattttgtagggcttacagaaagaagaccagtagcatctgttagttttttaggtcgttatgcattgattgactttgttttatcaaatatgtctaattcaactattgatgcagtaggggtgttgattcaaaagaaaccacgttcattgtttaaacatttagcaggtggaaattcttggaattttaactcaaaagctggaggtgtttctttcttatataatgaaagatatgcaaataaccctaattataatcacgatattaataatttgattgaaaatattgcgtttttggaagctaatagtgctgattacgtagtgatcgctccagctcatattattacaactatggattatagtgatgtaattgaaaatcatgaaaaagctggtgctgaagttacaatggtttataaaaaagtacatgatgctaatgaagcatatattggatgtgactgtttaacagttaaagataaaatagttactaaagttgaacgtaataaaggaagtcgtaaagatcgcagtatttcattagaaacttatgtaattaatactaaagtgttattgaaaattatgaaacaggctcaaaaaattagttcattctttagtttacgagatgtgttggcttatttatgtgatgaaaaacaaattaatgcttatgaatataaaggttatgctcgctgcatggattcattagaacattattatcaatattcattagaattcttggatctagatatttcatcagctgtgtttaagagtaactggccaatttatacaattacaaatgatacaccaccagctaaatatttaactggttcagatgttagaaaaagtattgtcgctaatggtgcaatgatcaatggaactgtagaaaatagtattattggacgtaatgttgtaattggtagtggtgcagttgttaaaaattgtattttgatgtctggtgcagtcgttagtccaggtgctgttcttgaaaatgtaatcatggataaaacttctaaagtacaacggcaattaaatttaaatggtgatagttatacaccgttgtatattaaagaaggagatgtggtttaatgcgggttttgtttgcaacttcagaagctactccatttattaaatctggaggacttgctgacgtattaggttctttacctaaagagatggtaaaaaaaggtgttgaaagtatcgttgttttaccaaagtatcaagatatgaaattagcggatgaaattgaatttgttactaattttgatatttgggtaggatggcgtaaggtttattgtggtatatttacttatgtgttggatggagtgcgtttttacttcattgataatgaacaatattatcgtcgtccaggtttatatggttatgatgatgattatgagagatttgcttattttgattttgcagtacttgaattaatttctcatttggatattaagccggatattttacatttgcatgattggcagacagcaatgattgcaatgttatataaagaaagatattgttattatgaacattatgataatattaaaatagtctttacaattcataatatcgcattccaagggaaagcagatcctaaattgttaagtgagttatttggattggataattatctatattataacggtaactgtcgaaatgatggatgtttaaacatgatgaaggctgctattttctatagtgatattgttacaacagtatcaccaacttatgcacgtgagatcttaacacctgagtatggtgaagggttacaaaatattttagagatgcgtaagtatgatttgtatggaattttaaatggtgttgattatgatgtgatcaatccagaaactgatcctcaaattgtcaagaattataatgttgatacagtatttacagataaagttgttaataaattggcgcttcaaaaagaggttggattacctgagaataaagatgtagcattaattgggatcgtaactagattgactaaacaaaaaggattggatttaattataaatcaattcagcgaaatgtgtagtcgtgatgttcaaattgttatcttaggtgctggagatcggacatatgaagatgctttaaaaggaatagcttatcatcatccggacaaagtttctttacaattaaaatatgattttggactatcttgccgtatttatgctggttgtgatatgttcttaatgccatcattatttgaaccttgtggtttatcacaaatgatgtcgcttagatatggtacgattccaatcgtgagagaaacaggtggtttgaaagatagtgttgagtcatatgatgagtatgctaatactggtacagggttcagttttgcaaattataatgcccatgaaatgatgagaacgattgattatgctttaaaagtatatgataatgctcctgatgcatggcgtcaaattatgattagagcgatgaatgctaaacttgattgggatgctagtgctgaccaatatttgaaagtatttaattcgttaatggaataaagacagagcaatctgtctttattgcttccatagaggtcatgatagattttgatgtggagattgatattttttgggtattgtcttatttagatataaagaaaattttaaatttataagctgaaaggaaaatatatagttatgataaaaataattttttttgatgttgatggtacccttatttctaaagaacgatcttacattagtgaaaaggtgttggtggcattaaaacagttaaaagagcagggaataaaattgtttatagcaacaggacgtcattatttagaattgggattgttaggaatcaatgagcagtttacttttgatggatatttaacattgaacggaggatattgttttgatcataaaggagttattcatagtaatccgattgataaagaagatgttaaaagagttgttgaatatacaactaaacataatttagcttgtagttttgttgaaagtgatggtttatatgttaatttagttaacgaactagttgaaaatgctcaaatttttttgaatacaccgattccaccagtcaaagatataactagagcaatagaaaatgatgtttatcaaattgacccttttgtaactgctgaagaaataaaaaaaatcatggctttaactaaacattgcaaatatacccagtggtatgaaagtggctacgatgttatacctaaagctggaggaaagcaagatgggataaaagcgattattgatcattacgggattaaaataagtgaagttatggcttttggtgatggtcataatgatatagaaatgttatcatttgtaggaactggtgtgtgtatggcaaatggtcatgatgattctaaaaaggttagtgattttgtgactggtagtgtctatgatgatggaattgtgacagcattagaacattataaattaattgagataaaaaatgactattaaatatggttgtaataatagttagagttgtgtaaaattagaatagtagaggagtggttgtaatgaaaaaactgattctaataattattacaactttatgtttaagtcttattgttgcatgtggtgcacttgatcgagaagtgaatttagagaaaaatggaaaaaaatatagtacagaacagggtgttagtttttattatcctaatgattttgaaatcaatctagattctaaagataatagtacagtgaaattttctaaggataataatatgttgtatttcacagtgttaaaagatgaatctgataatgtgctggaagataaggatgagctgtatactggagaacttgagcagggtggagcttcttccatagaagtatcacgaccagtacttgatagcggactaagtgtatatcaatatatttttacatacagtgatacaggaattaaagctatggaaattgtttattttggtgataataatacttatatttatggttattgtgccacgaaagatgattatgatgctaatgaaaaagatatgcgagtttatttacaaagtttttcaaagtcaacagggaaataagttgtattttagatattattttgttaagatatgtttaaattatagacaaaaggaataaaattattagaagtttataaatatattttagagatgaaaaaaattatttttatcggggttttttgaaaagaaaaaacgtgaaatagcgttaatagaaattttaaagcatctattattgggtgaagtaacatattatcccctaatagtaccatgcttttttatttatggaggtaatcatgaaattatttaatactcttacaaacaaaaaagaagaatttaaaccgattcgtgaaggtgaagttagtatttatgtatgtggtccaactgtgtataattatgttcatatcggtaatacacggccaatgattgtttttgatattttaagaagaacttttgaatatttgggatataaagttatatttgtatcaaattttactgatgttgatgataagatcatcaaggcggcaaaagaagagggagtcagtgaaaaagaacttacagataagtatattcaagcttatgaagatgttcgccgtgatttgaatttattgtttccaacgtatgctcctcgtgttacaaatacaatggatgcgataatcaactttattgatgatttggtgaagaaaggttatgcttatgaagtagatggagacgtttattttagagtttctaaaattaaagaatatgggcaattatctggaattagaattgaagatttggttgcgggagctagtgagagagttgatgaaaatgataaaaaagaagaatcaactgattttgctttatggaagaaaacagatgaaggaattcaatttgatagtccttggtctaaagggcgtccagggtggcatacagaatgcgttgttatgatcaatgatatatttgaagatggtaagatcgatattcatggtggtggtcaggatttaaaattcccacatcatgaaaatgagattgcacaatctatggcatgccatcatcatcctatcgctcatacgtggatgcacaatcaaatgattaatattgataatcaaaaaatgtctaaatcattaggaaatgttatttgggctaaagatttgataaatgaattaggatgcaatgtatataaatggtttatgctttctagccattatcgtaatccattgaatttgacagatgaagtattaaatagtgtcaaaaaagaagtcgctaaagttgataatgtaataaaagcggcatcattgtatctacaggttaacggtattgatggcaaagagtattgtaaggaaactatagatacgatggttaaagcgctagaagatgatctgaatacttcattggcattgacacaaattttgaatcaggtaaaaaatttgaatcaattaatgcgtgttaaagaaaaagataatgaattgattttaaagaattataatactttacttaaaatgacagatgttatggggtttgtttatgaacctcgtcaattaagtttggatgaattagaactgtatcaaaattgggtggcagctaaagaagtcaagaattttgatgaggcggataaattgcgtaatgaattaattagtaaggggataatttaatgcgaccagatttggttaatgcggctgtgctggcttatttaggtgatgcagtttttgaagtaatggttagagattatttggttagagaaagtggactggcaaaaactaatgattttcaaaaggaagcaattaaatatgtatctgctagttcgcatgccatgtttatgcatgatatgttagtggaagatttttttgacgaaagagaaattggaatatataaacgcggtcgtaatactaaaggtagtaaaaatgaaagtcttgagcatttgcattcgacgggctttgaggcgataattggaactttatatttagaaaaggattacgatcgtttggaattgatatttaaacgatataaagagtatataaaagctaaataaatttgagataaatttgagacgaaaataggtgaaaaatatgaaacaatatatatatggtaaaaacacaatattagaagctttaaaaggaaaaaagagtgtgtatgctgtgtatatccaaaacaatgcaaaagatagtagaattatcgaattgtgcaaaaaaaagaaggttcatgtaaagatagttgataagtctgagtttatcaagaaattaggcaatgtaagtcatcaaggggtcatggcagaaatagaagaatatcgttattatagtatcgatgagatattaaatgatattcctaaagaaaaacagccgttattattgatgcttgatggtttagaagatcctcacaatttaggtgctatactgagaacatgtgacgccgttggggttgatggtgtcattattggtaagaatcgaagtgtagggttgaatggaacggttgcgaaggtatcaacaggagcgatcgatcatgttaaagtggctcaagtaacaaatctagcaagaacgttggaagatttaaaaaaacgttctttttgggtagttggctgtgatcttgatcaatcgcaggattatcgtcaaatagattacaacatgccacttgtaatcgtaataggatctgaaggttttggaatatctcgtctagtgaaaaaaagttgtgatttcaatgttgttttaccgatggtaggacatgttacttcgctgaatgcttctgttgcaacagcagtaattttgtatcaggtatacaattctcgtaatcctttataagcagaagggaggtaaccatgaatggttacaatattgaagaattgtattatttatatcgacaaggcaatcctgttgcgggaaaattgttgattgagtactgttattggcaagtggaaataatgttgccgatatattatttttatagtgaaaattatcgtaatgaacgtgatgattatattcaagatatcgttattcgctgtgttaaaaatctagataattatcgtccagataaagggatgctggttaaaagttatttatctatgattattcaacgagcgattagttcggttatgattagagaaaaaagaaaatcggtcaaagaaaaaaatgtttgtttttcattgaacagttattgtagtgaagatggcaaagtaagttattttgatattgttaaggataataatttagagtatcagccagatatccgaactgttcaatgtgaacaaaaggaaacgattgaaaaatatattttggaaaattgttcatgtttagagcgctcggtaattaaaggtcatgagcttggtttaaaagacgttgaaatagctaaagcattacaattagatgttaaaaagatatataatgcaaattatcgaattcaaaaaaagatgtcaaggctaaaattgtttgactagttgatatatttgtgataaattataatagcgtagaaatgagctgattatatgaaacaaaaagtgattttggtttgtagtgaatgtttatcaagaaactatacaattaccaaaaataagcgtgtaaatgttgaaagattagaattaaacaaatattgtaaaaaatgtggaaagcatactttgcataaggaaacgaagtaggaggtatcggtgtgaaatttagagattggtttagtttaaaaggaattagaagtgagataaagagagttagctggctaaataagaaacaactagcacaaaattctgcaattgtattattgttttgttttgtgttaggagtgtatttttttgcaggagatgcaattattgcctttattttaaaagcgttggggatgaattaaaatgacgggaatgaatgatgaaggtagacaatggtatgtggttaatacatattctggtcatgaaaataaagttaaagagaacttagaaaaacgtgttgaatcaatgggattgcaagatgttttatttcaaattgtcattcctgaacatgtggaaacagaaattaaggatggaaaaaaaataaataaaactaaaaatatgtttccaggttatgttttggttgagatgattatgacagatgaagcctggtatgttgttcgtaatacttctggagttactggatttattggttcttctggtggaggtgcaaaaccttttcctcttcaaaaaagcgaattagatccaattctaaagaaaatgggattgagtacgagcattgaagtagattaccaggtgggggatgaagtaaatgtagttggtggaccttttgctggtaaaagtggtagagttgaatctattgatactgaaaaagaaactgctaaagtactaattgattttttaggaaatttaacgccaatggaaatagaattgacacaattggaaaaagctgatttatagagtagatgtcatgtttataacatgacattttttattaaaaatattaataatagaagaatgatgatgaatgtaaaattatattatgtttacagtcaaaaaaataggtaaaaatagttttataatcaaaaaatctccctgaatataatactttttttgttttatatattaaacatcttttttaataatttgaattttgctgatttaatcgagagaatttgcattttttcataaaaagtgatataatagaaatgtcgttttagataggaagtgagttaatggagaaaataaagagtgaaaaattaaataactttattaatgaaaatattatcaaacgtaaggctatgtttattccgattctaggagtatctgtatttatgctggtaggttatgcagcagtcgataatgaagcaccagaaatagtttcaaatcgaattgaggttgcatatggagaaaaattagatttaaatgcaattgacattaaagataatcatgatcagcgagatgaactggttgttgcagttgaagaaggaaaagtagatgtcatgcagttaggtacttatgaaataactgtcagtgctagtgactgttcatcaaatgtggctactaaaacaatcgatgttgatgtggttgatgatgaagctccacaatttaaagtggttggagcagataaaggatatgttgttcaagtaccgatcaatggaagtaatgacgtaacgagttatattaatgcaattgataatgttgatggggatgtctcaccatttattgaaacagataaggaattagatgcttctaaacctggaattcaagatattactttaactgttgctgattcttctggtaatgttaacgaaaagatgtttgaatttgcagtgtctgatttaacaccgccaagtgttactttaccacaaggaaatgatatagttattgattatgcaagtgaatttattttagaaaactacttggttgctagtgatgatatgggtggggtaactaatactgttactggcagtgttgatacaagaaaagaagatgaaattcagactattaaggttagtactaaagacgaagctaaaaatgaagttgtttcagtccttaatttcacagtaaaggatattagtggaccgcagattactttgactactgatagtactgaagttgttaagggggatccatttgatccaagagcttatttagtatcagctattgataataaagatggtgatgttactgcaaatgttgcaattagtaatattgatacaagttctactggtgataaagaagtaacctatacggtatctgatacccttgggaataagtcggttgcgatattaaaggtaaaagtttatacgccaggaacaaaaattttagaaacagcttatactaaattaggaagtccttatgtatggggagctactggtcctaattcatttgattgttcaggatttacttcttgggtatatcgtcaacatggaatatctttatcaagaactgctcagtctcaatctcaaggtggaacagcagttgaacgtagtgatttacaacctggtgatttggttttctttggttcgagttcaggtcggattacacatgtaggaatatatgttggtgatggtaaaatggtacattcgcctcaaacgggtgatgtagtaaaggtttcgccactacaaaaaaattatgtgtgtgcaagaagatatttataaaatatagtaaaataaggatatcagaatcttaaatggttttgatatctttttttgttttgagggtcgactattgacatattaaactgtttcttagtataataaatatatcgataatcgacatatttattatatcgactatgaatgctaaatgttaaaagtttaaaaaaaggagaatagaaatggcaagagaacagtatcaaagattaacagaaccaatgttttatttattgcttagtgtggttgaagagaatcatggctatgcgatgatgcaggatattcagatgttatcgcataatcgtgttaaggtagggaatggaacgatgtataatttattagaacgttttttgaaagatggcataattgagctgacacgtttggaagctagaaagaagtactataaaattacttctaaaggattggatttattaaaggaagagcgtttgtgtttaaagcgacagatagaagattctaaatttttgggggaatagatatggtgtgggtgtcttgttgtttttatccaagtgaatataagaaagtgtttgcgcttttaaatgacatgaaacaggatggatatgttataaaatcagttgattttataaatggtaaagctgaatttgtggaaactaatgataattttatttatggaattaattattctttgttatatcctcatataaaatgtttctttaatgaagagaatgaacgttttgatatggcaaaattatcaggatggcgattgcaatgttatgatgaaggaataggaatttggattaataaaaatattgaacaggctgtgccttttttcttagatgtggaatacgaaaggattgaacaaaaagattatcaaaggaatttaaaaacttttaaaaagtggttggcttgtttgtggtgtttgtttggtttaagttttttaatatttataactgctaaagaaatgaatttttattatcagggattgttgttaatgtttatgatttttgcaagtatgtggaaaataaggcatcatcagttgattcctgataaagtatttaatatattgtttaaaaattatgttattgctttttgttttggctattttcctttatggttatcgatggttttggaagttataacattattgatttcgattgatgttattcgtgaaaagtcgtttgtttttaagaatagtaaatatataaatatttataatattgctattttgattcttgctgtatatgcagtattggtgtataaaatatagaaaatatttattaagtaatcattttttttgagttttttcatataggtgtataaagtgaggaaaaagtgatgaaaacatttgatattataaatatgttgtatgaggatagccctaaggcttatgcagttatcagaggtgaaggaataaggggaactttactagtttatgaatatgataaaggaagtgttttggtagttgatgttcaaggtttaccagatacagagtgtggacagggagttcatggttttcatatccatgagggggcatcgtgtgtaaaaaatgcagcctcagaatattatgaggctggaggtcattttagtatgaatgattgtaaacatccttatcatagtggcgatttaccgcctttattttcaaaaagtggtcaagcatggatgagtgtatatattcaaaagttcacaccagatcaaattgtcggacgaacagtgatcattcatgaaaaagctgacgattttaccacgcagccttcaggaaattcgggaaaaatgatagcctgtggtcaaataattgaattatatcaataaatttgttttatctaagcaaaaatacatttaacttatgttacaatgtattagcggaggtattttatgaataagttattgttttttgatattgatgggactttgatagaatgtaatttagggatttattctattccagataaattaagacaagatctggaccaactaaaagtaaatggtcatgatgtttttttagcaacagggcgctgtaaatgttttattacagatggtgtcatggattatccttttaatggttacgtaacatgtaatggtggatatgtcgaatatcttggaaaaccgatttataaggcagttgtccctagcgcggctattaaagcgacaatggcactttgtgaaaagtatgattttaattattattttgaaagtactgattttatttatgttcgtgattgtaagaatccaaagcatatagagtttagtcaaaagtggaaaatgaaaccagaaacagtaattgaccgatttgatcctgataaaatagagacatatatagggatgatcgtggttaataaaatagaagacattccaattatggttgaagcattaagtccttattttgatgttcaaagacatcaaagtgattgttcttttgatttaacattaagaggtgtttcaaaagctcttggaattagtgaattagtcaaaaatataaataaagatatcaaggatacgattgcttttggtgatgggcgaaatgatattgagatgttagaaacggttggtttagggattgctatgggaaatgctgttatagaggctaaagctgtagctgattacgtaactgatcgaattgaaaacgatggaattgaaaaagcgttaaaaaaatttgaattaatatagcggccaagtgctgcttttcttatttatttatagttttttttagtgattggtgctatgatatgactaaaattatagaattgatataaactgttattggaaggagataaaatatataatatgttgatgcaaataacttgtttgattatagggtttattttgttgataaaaggagctgatatatttgttgaaggagcttctaaagtagcatcgaaattaaacattccaccaattgtaattggcttgacaattgtagcttttggaacgagtgcgcctgaagcagcaatttctattacttcggcgttgagcggtaatgttgatttggcagtgggaaatataattggtagtaatatcatgaatgtattgctgattttgggaatttctggatgtatagcacgtttgaaagtgaagaaaaatacatatcgttatgaaattccttttgtaatggtgatcactttgattttgctgatacttggaaagtttggtgagtcaattgatcgctttgatggagtggttttatggatcttgtttttaatgtttttatattatttatatcgattagttaaaaaaggtgaggaagtaccgatagatgaggttgaagaagttggtgctaaagatacactgttacgattgtttataatgattatcatcggaatagcggcgattgtgataggaagtgatatgacgatcgatgcagctgtttatatagctaaagtgattggaatcagtcaacggttgatcggtcttacaataattgcatttggtacatcgctgccagaattagtcacttcaatgactgctgcctggaaagggaaaagtgatctagcgattggtaatatcgttggaagcaatatttttaatattttatttgttttagggactacagcattgatttcgcctaacgcgatagcttttgaaaatggttttattagtgatggaatcgttgctattggagcattatttttgttgtatgcatttattgataatgatctttttttgaagaaaagtggagcaatcgtaatgctgataggttatattgcttattttataagtgttttataggagaaaataatgattaaattaggacatagaggatatagtgaaaaatatcctgaaaatacgatgctggcatttaaaaaggcaatcgagggtaattttgatggtattgagactgatgttcatttgacaaaagataatcgattagtattgattcatgatgagaaaataaatcgaacttctaatggaaaagggtatgttaaagattatacttatcagcagttatgtcagtttaattttaattatcgatttaaagatattgatgcaaaaattccgctattagaagaattactggattattgtatggataaaaatgttattttaaatattgaaataaaaactgataaaattcaatatctaaatattgaaaagatgacatatgagatggttaaagaaaagggcttgttgaataaagttatgttttcttcatttcatttagatagtttattaaagttgcgggaattggatgatacattatatcttggttatttatacgaagataattatgaaataaataagaaaaaagtttttaaatataaatttgatgcagcgcatcctaaatatgtattcttaaatgaaaaagaaattgaagattatcatcgtcatggtgttgatgttaatacatggacagttaataatgaggatattaagaattttctttcagaagcaggagttaaaacaattattacgaatcgagatatctaagactattttagtcttagtttttttgttgcataataatttgacgctaaattaaatgttagcgttttcaagtataataagctgcttttgttgtgaaaaaatgcacaatattgcttgtcttttttgccaaattggggtacactatcaatggaaacaaattaaatatttcacaatgaattggaggaagaaataatggcagaaaaaaaagctgttaacaaagtagttgaaccaacaaatgaagaaatagatgctaaagttgatcaactagttgcaaaagctcaagtagctttatcaaaatttgaaaactttactcaagaacaagtagattatatcgtagctaaatgttctgtagcaggattagatgctcatggtacattagctgaagcggcagttaatgaaactggacgtggtgtatttgaagataaagcagttaaaaacttatttgcttgtgaatatgtaacaagtaatttacgtcacttaaaaacagttgggatcattaatgaagatccacttttaggaattactgaaatagctgaaccagtaggtgttgtttgcggtatcgttccaacaactaatccaacttcaacagtaatttttaaatcattgatttgtttaaaaacaagaaacccaatcatcttctcattccatccaagtgctcatgcatgttctgtaatggctgctgtagttattagagatgctgctgttgctgctggggcaccagaagattgtattcaatggttagatgttaaatctatgtatgcaactactgcattaatgaaacatccaggtgttgcaactatcttagcaactggtggtaatgcaatggtagctgctgcttattcttgtggtaaacctgcattaggtgtaggggctggtaacgttcctgcatatgtagaaaaaacatgtgtattaccaagagctgtaaatgatattgtattatcaaaatcatttgataatggtatgatttgtgcttctgaacaagctgctatcgtagatacagaaatctatgatgcatttatgaaagaaattaaaagatttaaagtatactttgtaaataaagatgaaaaagctaaactagaacaatttatgtttggtgcagttgcttatggtgataatgtaaatgcagctaaattaaatcctaatgttgtaggaaaacctgctgtttggatcgctgaacaagctggtttcaaagtgcctgaagatacacaaattatttgtgctgaatgtggagaagtaggaccaaatgaaccattaacaagagaaaaattatctccagtattagcagttttaagagctaaaaatactgaagacggtattttaaaatcaactcaaatggttgaattcaatggattaggtcactctgctgcaattcatacagaagatcatgaattatctaagagatttggacatgcttgtaaagcaattcgtattatcgaaaatgcaccatctacattcggtggtattggttctgtttacaatgcattcattccatcattaactttaggttgtggttcttacggacataactcagtatctaataacgtaagtgctgttaacttaatcaatattaaaagaatagggagacgtaataacaatatgcaatgggttaaacttcctccaaaaatttatttcgaaaaaaattcaattaaatatctaagagatatgaaagttatggaaaaagccatgatcgttacagatagaggaatgtacaatcttggttatgtagaaaaaattgaagatgtaattagaagaagacgtaataaagtagatttagaattattctttgatgtagaaccagatccaagttttgacacagttcaagctggacttgaattaatgaacaaattccaacctgatactattattgcattaggtggtgggtcttcaatggatgctgcaaaagttatgtggttattatatgaaaacccagaagtttgcttcgatgatattaaacaaaaattcatggatattagaaaacgtgctttcaaattcccagaattaggaaagaaagctagattgatctgtattccaacaacttcaggaacaggttcagaagttactccattctcagttattactgacaaatcttgcaataagaaatatccattaactgactatgctttaactccaactgtagctatcgttgatcctgaattcgtaatgagtttaccagcttctattgcagctgatactggtattgacgtattaacacatgcggttgaagcttatgtatctatcttagcttctgactttactgatggatgggctaaacaagctgttaaattagtatttgattatttagaagaatcagttactaaaggaactccattagctagagaaaaaatgcacaatgctgcaacaattgcaggtatggcatttgctaatgcattcttaggtatgaaccactcattagctcataagattggtggagaattccacgtaccacatggtcgtacaaatggtatcttattaccacacgttattaaatataatggaactattccaactaaattaaatatctggccaaaaattgaaaactataaagcagatgttaaatatatggaattagctcaattaattggattaaatccaaaaactcctgcagaaggtgttcaaatgtttgctgatgcatgtgaagaattatgtcacaaagttggtttagcatctaacatcgaatctcaaggaatcgataagaaagattgggatgaagcaattcatagaatggctatgaatgcttacgaagatcaatgtactcctgcaaacccaagaatgccaatggtacatgatatggaagcaatcttaagaactatttgggattacaaaaataaatttgataagtaataatatagtgttttagagacaaccttttataggttgtctcttttggtaataaataggtattttgatatatggaaatctattgatgaaaattgtttaaaagtttaattgcaataataacattaaaaaaatggctttttaaatacaaattaatgatagttagtgaaaatattatttccacaaatatttatttataatatgttgacatttaaataaaaataggttatatttttatatgtattatggttatgtaaaagaaagacaataatacttgcataggtgacccctctcccatataatcacctatgcaaaaagaggaacaagaaattgttccttttttttctaataggaatttcgattcgtttaggtataaaataaaaatatccaatcataagggtacatttattggctggatatttttatgtggctaaaaaagtgttagaaatatcattttttcctaaccattcttccattgcattttggacactgacagctgtatccttgattctctttacctgaatatatttcttcacctaaaaactcttctagtatccattccggtacttcttcttcataaccacatctcttacatttcatcggtatcattacctctggttcccctaataattctgctagttcttcatcggtcagattgatcacttgtttaccttcttcctatgctcatagctgtattttgctttgagaatctttcggtcacgatattctctgtcatttttatcgtttccaccaaatggttcatagctttctttatattccattgtttctccacattcacaaagcaatggatcccgttgaaatgattttatcatattatatctgaaatgtaactctttttgtctcttttctatcatcacccttctgtcattttttagttcttctactcttttttgtttatggctcaacagttcagccatcctgttataggtctttattgatttatttgaataaaaaccaaaatatcttaccatcttgaagttcttttcaggacagtgcatcaataccttgttaagaaaactgtaaacagattctgtgacatctacacgcttattatcttcatgacgatgatagaaccaatgaatcattttcttatcatcatcatagtttactatcctgctttcagccattattggtctgctggtataacgggttatatattgaacacatttttcaatgtcgtccttagtctgttcatctttgatttttggagcatagacatagaacccttcctcgtattttcggtagaaccagcttttaaggctttgaaattctttgtcgttgccaatgtgtctgtcaagatagctgagtaattgataacgccatgtctggcgaagttttttatagtccatataactgaagtttttgattttgttatctttagaatcataagcatcttcgcataccagaacatggatatgcggattccagtcaagaggtctgccaaaagtgtgcaatgaggcaatggcaccaaagatcacattatcagttgtatctttgtaaagatattgagatttattgctttttttatgatagaagatacctttctttttttcaagacgcttttgtctgcgatattttctgtcgttgaaaagggaagccagagtatttctggcaacgacaaaaagaccatcaagcagtgatcggtttttgataaagtagaagcgaagctgagcagggatggtaaagacgatatgacgatgtttggatttaaaagccatagagctgacataagcagcgcgtctttgactggatttagaaccacatttggtacagtatctggaactgcaggtatgagcaacaatagtttcattgccgcagttaggacagacaaagagatcataaccaagatggatagaagaacaaaggatagttttttgaacattatcaaaagaaacatccctgagtttgcctttatcatgtagattaatgatatagtcgtaattgtcaaagaagatatatttaaaagtatttttaccgtcttttttaacaaactgcttaaaattaaaaagacctaatgtatcagaaggaacagataaatcgatcataaagtcatctcctaaaatcattataataccaaaaaggatgaaaggcatttaaaatgcactatcacccaggtggacaaaatttattttgtcccttttttatacaatttataagaaagttcataaagtgttcataattattctttaatattacagatgtcgtcaagacaagataatatataaagtataggccacccccttcttccccaagaacggcctatacatttaagagagtgtaccccagcactctcttttatttaaataatctatgctaaaaaattcttgcctagataataaaaatttgctagaatgtaaaagggctatagtatgtcttccatggaagacatttttatttatatacaaaggagattgaaaatggcaaaatatatttttgtaacaggtggagttgtttccggattaggaaaaggattaactgctgcatcattaggtagaatattaaaacaacgtggattaaaggtctttatgcaaaaattagatccctatattaacgttgatccaggaactatgtctccttatcagcacggagaagtttttgtaactgctgatggagcagaaactgatttggatttaggacattatgaaagatttattgatgaagcattaaatagaaattcatcagttacgacaggaagaatttatagcgatgtaatttttaaagaacgtcgaggagattatttaggggcaaccgtgcaagttgttccccacattactaatgaaataaaagctaaaatttatgctgtggcttctagctctaaagctgatattataataactgaaatcggtggaacgactggtgatattgagagtttgccttttttggaagcgattcgtcaagttcgtttagatttaggatatgaaaatactttatatattcatacaacattgttgccatatattggagctagtcatgaagtgaaaacaaaaccaacgcaacatagtgttaaagagttacgaggattaggaattcaaccagatttcattgtttgtcgtagtgaaaagcatattgaaaaagagttaaaagataaaatttctcttttttgtaatgttccaactcaaaatgttatctctaattatgatgtggaagttttatatgagttacctatgatgctattagaacagcatatggatgatttggttctcgatcatttaagaatagaggcgccaaaagctgatatgaatgaatggcaaaatttaattaatcgagttaaaggattggatcatgaagtgacgattgcgttagttggtaaatatacacaacttccagatgcatatttgtcagttaatgaggctttaagacatgcaggttattatgaaaatagtgttgtaaatattgattttgtagattctgaagaaatcactaaagataatgttgctgataaattgaaaaatgctgatggtataattgtgccaggaggttttggtaatcgtggaattgaaggaatgattgatgcaatcgaatacgcaagaataaataaattaccattttttggaatttgtttaggtatgcagctggcaacagttgagtatgctcgaaatgtatgtggtttagaaaatgcaaattcattagaatttgatgaattaactaaaaatccaattattactttaatgtcagatcaatcgttgacagatatgggaggaacccaaagattgggtgattataactgtgagttattagatggaactaatgctagaagattgtacgattcatcaatgataaaggaacgccatcgtcatcgttatgagtttaataatgattataagaatatattagttgaaaatgggctggttattgcaggaattaatcctgagcgtaatttagttgaaattattgagattaaagatcatccatattttgttgcttgtcagtttcatcctgaatttacaagtcgtccaaatagatcacatccattatttcaaggcttgattacagcagcacataatcgtaaatacaaagaataggcttaggcctatttttttgtttaaaaaaatttaattattcattattttttgttaatcatttcttaaagttatattggtaggattttatagaagattttgttataatacaataaattatggaggataattatatgctggagactaaatcaactaaaaaatttcgaataataaaaggaattatttgtattttgacattaactatgctgattggagcaatagtatgtttgttcattgttgatgataataaaaaaattagacgtttgattttttcaattatacaattattattaatgatgggaattattgttttacctgaacgtcttaaagataaaattggattgaaaataccgattatgttagaaacttcattgacagtttttgctttttgtggttttgttttaggagatgtatttgatttttatcgaaaatttccaatttgggattctatattacacactttttctggtgtgattttagcttatcttggctttgtattaatagattattttgttaaaagagatagtattaatttgtatatgggacatatgtatatttgtgttagtgttgtcttattttctttgtctttaggagctttgtgggaaattggagaatatctagttgacgatatttttggaacaaacaatcaacaatatatgaaatctacaagaggaacattatatggtgaaaaagatgagccattacaaggtcatgaggctttaaatgatacgatgaaggatttaatgttggatcttgcaggagcaactgcagtaggaacagttgaatatattagagaagatcatcgtaaacataagataagaaaagaacttaaatgattttaaatactaaagtttatgatgaagacttaaaattattgatcactcaataattttaggtctttttttcttttagaatttatatttatatctcaaatcaagaaaaaatcagcgatttaagttctttttaaaatatcctagaatataagctgttattgtgctagaatatggtgcgaaggggtgaaaatatgtatcgaattggacaatcaattgatattcaccagttagtatctggaagaaagcttattttaggtggtgtagaaattgaacacgaattaggattgctaggacatagtgatgctgatgttttatgtcatgcaattattgaaagtattattggagctttaggtttgggagatattggaaagcattttagtgatactgatgatcaatataaaggtattagttcattaattttattagaaaaaacgtataaaatgatgaatgaaaaaggctatgaaattagtaatcttgatgcaattattttgattgaaagacctaagatggcaccttatattcagaagatgaaagagaatattagtagtattttaaaatgtgatcctgctaatattaatattaaagcaacacgtggtgagaaattgggttttgttggtcgggaacaaggcgttgtttctcaatgtgtagtgatgttaaaaaagaaaggaatttaagatggaaaaagtaagagtaagatatgcacctagtcctactggtcatttacatataggtggagccagaacggcattgtttaattatttatttgcaaaacattatggtggagattttgtttttcgtttagaagatactgatattgaaagaaatattgaaggtggcgaagcgagtcagttagataatttagcttggcttggcataattcctgatgagtcaccattaaaccctaaaaaagaatacgcaccatatcgtcagatggagcggttagatatttatcgtaaatatactcaagaattattagatcgcggtttggcctataaatgtttttgtacgccagaagaattggatgaagaacatgaacgtcaagtagcggcgggtattgctccgatgtataatcgtaaatgtcgtgatttaacagcagaggaagtagccaaaaaagaagctgcaggaattccttatacaattagacttaaagtaccagctggtaaaacctatgaatttgatgatatgattcgtgggcgtgtttcgtttgaatctgacgatattggagattgggtgttagtaaaagctaacggaataccaacttataattatgctgttgttattgatgatcatacaatggatattacccatgtatttagaggagaagagcatttaagtaatacgcctaaacagatgatgatttatgaaatgtttggctggacacctcctacttatggtcatatgacattgattgtaaatgaacaaagaaagaaattatcaaaacgtgatgaaagtattatgcaatttgtttctcagtataaagatgaaggatatttaccagatgcaatgtttaattttatggcgttattaggatggtctcctgaaggagaacaggaaatttttagtcaagaagaattgatcaaagaatttagtgaaaaaagattatctaagtcaccttcaatgtttgataaagataagttaacatgggtaaataatcgctatattaaagaaagatcgttagatgatgttgtagctttatgtagaccatttttagaagaagcttatgatttgtctgataaaagtgatgaatggatcaatatgttagttgctacatatcatgatcaattatcttatggtaaagaaattgttgccttagttgatttattttttaatgatgaattgaatttagatgatgaagctaaagaatttatgaaagatgatagtattcctaacacattaagtgtttttaaagctaaattagaaacattggatgaatttactaaagaaaatattcaagcgtgtattaaagcgacacaaaaagaagccaaggttcgtggtaaaatgttatatatgcctttaagaattgcgacaacaggaataatgcacggtcctgatttagctagttcaatttgcttgttaggtaaagaaaaagtgttgatgagattagaacagttttaactgttctttttttgtgtattattttactagtgattgtaaaaaattgctattttttttaggttataatattaatagaggttaatataaggaaggtggttaaagaataaatattttatttatgttattaaattttaaggaaaggggaaatggatatggatttaaaaaaattttttaaatgtttaatgttggcatcacttgttgtatcattagtggttccaactacgggagtatttgcaaatgaaagatacgatgattctgcttggatagatgtttcaagtagaacgtcaaaagaaaatattgctttaaaaaaacctgtaacatcttcaacaatagaaaataaccaatatgcatcgtatgcagttgatggcaatgaaaatacatattgggcatcagttaatcctagtgagttggaagtggatttacagggttactataagatttcagaaataaatttaatggcatattttgatggggcatcagtaaatcgttattatgattatgaaatatatgcaagtatagatcaacaaaattataatttggttgctaaaaaaaatgatacgaactggaatacaccacaaggagatacgtatatttttgatgatacttttacagcgcgttatataaaggtaaagatttcaaaaacgcatgcagaaaatcaaccgaataataatactgggcatattaaagaattacgagtttatggagaattagatccagcatatgaaaaaataaaaacaaatgttgctttaaataaagttgttacagcatcaggacaagaaggcagcagtaatccagaaaaggcagtagataataatactagttcattttgggcagtagctggagagggctggttagaagtagatttggaaggatattttgatgttgatgaaattaatgtgcttccatactattcagatggacgttattataattatgaagtatatgttagtgtaaatggtctcgattatattaaagttggagaaaagaaggataatattccacaaacaagtgatggagatacatatacatttgaaacaaaaacaattcgttttgttaaagtaaaaatgttatcaaattcagctaatccatcaatgcatataaatgaattaagagtttatgggatagaaaacttagattttactcctcctatagaggatgtcgatactactagtattgcatatctaaaaccggctcgttcttatagtaataatgctagttatccggtttcaaatataaatgatggactattatcgacagtatggcaggcattgtattatcctgcatatatagacattgatttagaaaataattattatattaataagattcaagtgattccaagttttaaagatttacaagcgtattatcagtattctgtttttacaagtatggatggtgtaacttttgataaagttggtgaaaaagttgatgatactcttgtaacaaaagatggaaatatgtttgcaatcgatggtaaagaagctcgaattgtacgtgtttatcttgaatattgttcaattggaaatactggaagttttgctgaagttagggtatatggtgatgaaagtgaaacgccaatagctaaacgttcagatattaagataagtgattttgaagatactgagtatgcaaaaccaattactaaaagtgaaacccttaaagaagtagaaggagtgctaagccgtactattggtgaaaagtatttagactggtttgagtttgtattagaagaaaatagtgaaagtgataatgattattatgagattagtaatcataatggtaaaattcaaatcaaaggaaatgagggtgtttctttaactacgggattgaattattacttaaaatattattgtaatgtttccattacacaacaagcgaggcaagttaaaatgccaaataaagtagttccggtaacagaaacgatccgtaaggaaacgccatatgaagtacgatacgcatataattattgtactcattcttatacaatggcattttggggtgaaacagaatggcaaaatgaaatggattggttagccttaaatggtgtaaatgctatccttgatattactggacaggaagaggtctggagaagatttatgagtaatttaggttattcaattgatgaaatcaaagactggttagtcgggccaggatattatggatggcagtatatggctaatatggaaaatgtcaatggaccaattcctgataactggtttgaacaacgtacagaacttgcaagaatgaatcaaagaaagatgcgtgcattaggaatgacacctattttacaagggtatagtggtatggttcctaatagtattactgaaaaagatgcaagtgtcgaaataattgctcaaggtctttggaatggaatgcaacgaccagcaatgttaaaaacgaatacagaaacataccaagaatatgcaaaaatgttttatcaagcacaagaagaagtgtatggaaaggtttctaattattatgcaactgatccatttcatgaaggtggacaaactggtggaataggtcggaatattgttggaagaaaagtattagatgaaatgaaagcgtatgataatgacgcagtttgggttattcaatcatggagttttcaatcggatttattaagtgaaattacaacggaagaaaaagaaaataacattttattattagatttaaatgctagtaaatcagcaagatatacatctacaaatgaattttcaggaagtagttgggtatattgtatgcttgaaaactatggtggtcgctctggtgtgcatggaaatcttgaaaaattaacaacaattccaagtcaagtaaaagataaaacaagtcatatggttggaatgggaattgcaccagaaggaactaacaataatccagttagatttgatttattctttgaaatgatgtgggaagaaagtgatgtggatttagatgaatggatcaagcattatgtggaacgtagatatggtagcagtagtgaaaatgttcaaaaggcatgggaaatattattagaaacagtttatcgtcctgcaactcatgctgatccaccagaatcaataattaatgtaagaccacaatttaatgcaaaacagtcagcgccaaatggtagtatgagcaaaaattatgatttgaaaaaatttgaaaaagcattgaattatttaatgaaagattatgaacaattaaaagatagtgaaggatatttatatgatgtaactgactttttaagacaggcagtagctaatagtgcagaaaagaaatatagtgaatttacgaaagcgtttaatgatgggaatattgaattatttaaagaaaaatctcaagagttcttagatatggtagaacttcaagatcaagttttaaatagtaataaaaattttatggttggaacatggttaaatgcagcccaaaatgcttcaaaaggacaagatgattttactaaaatgattttccaattaaacagcaaagcaattatttcaacttgggcaccatattattgttggggagtatatgattatgcaaatcgcgaatatggtggtttaacaaaagattattatttgcagcgctgggaagtttggattcaacgtttaacagataaaattgaaggtaaggatattagtaattatcaagagatttcagtagaagaatctcatcaaatggcttggcagtgggctagaagtgataaagaatacagtattgaagcaacaggtgatacaaaagctctatatgaagaatttataaataattattctttaaatgataattctgtagatgaactgcaagtagatcagataagtatttcgatttcatgcgataagcctaattataacaattatctaattagtaatgctattgatggaaatgagagtactttttggtcaacacaaaccaatataaatgctccatatacagtattctttaaatttgatcaagctgaaactattaattcatttagtattttaccacgaaattataatagcaatgcaacgggaaatggagatattttaggaattgaattatgggtaagtgatgatggtaatgaatatcgtatgattgcccaggaagaatatgaacaaaatggcaatgaacgtatttgcaattttgagacagttacaacaaaatatgtaaaattagtgattactaaaacattgatttggaataatattgctacaaatgcttcggcaacagcggcagaatttaatttctataaaccatatgctcaactaagaagtggtatatatacaattcaaaataatataattgaagatgtttatgaagatacaacggtaaaacaatttttagcaggatttgatatctctcaaaatggaaaggtaattgtaattagagatggaaatgaattaacagaaaatgatgtaattaaacaaggtgatatcgttgaatactattataaagatgaaaaagtagaagaatatcaaattggagaatttgtcaagttggcagattatacgcaattaaatgaattaattgcaaaatgtgaaaaacttaatcaaagtgatttcactttagaaagttggaatcaatttagtgaaattcttacacttgcaattggagttcaagtaaatccagaagctagtcaggaagaaatagatttagcagtagaaaacttaaaagctgcgtatgataatttagtcttaatagcagttgaaagtgataaaacagcattacaaatagctgtagatacagctaatatcttaaaagctcaaggggcattggataatgtcgtaccagctgtagcagctgaatttgaagctgctttacaagaagcagcagatgttttagtagacactggtgctgaccaaactacagttgacagtactttctatcgtttggctaatgcaattcatatgttggaatttgtaaaaggtgataagagcgctttagaagccttgatcaatgaagccgaaaaatatgaagaaaaaaattatacgactgattcatggacagcatttaaagaagccttagatgcagctagagatgccatgaatgatgaaaatgctttagaaagtgatgttaatgaagcgttaaataacttaacagaagtaattggaaacttagtcttaagagctgataaaacaagattacaagaagcatatgacaaagtagatggcttagataagagtctatatactgaaaacagtgtagcgggattagttgacccaatggcagctgctaaggctgtattagatgatccagatgcaacacaagctgaggtagatgccgcatatgaagcattgatcagagcatacttagacttgagattaattccaaataaggatctattacaaggattgatcaataaagctgagacattaaatgccacaaattacagtgctaagacatggtcagtaatgatggaagcgctaaatgaagcaaaagcaacattagctgatccagaagcaacacaggaagaagtagataatgctaaagaagtattagctaaagcaatggctggattagaagcaagtgatccagtaaaagccggcgatacaacagcaagtgtagctactggagataatggtttaattggaatctttgctagcttatcgattttaagttttgcgggattaagtttatttggaaaaaagaagtctaatatatgttgatttgtttacatatagaagattaggggctgtaacgagtaaataattattttacagcttcataaaacaaaaaaagcgctcaagcgagcgtttttttggtataatattttcatgtcaaatattaatattaacacttcaaattataactcatttcaatcttatttgctactggatttttctttttcttttgaaaaagatgttccccatgatgatatttgtagaactgttttagaagtcgctcgggaggtaaatataaataagtatgtcgacttctctcacagaaatacccatggttatgattcctttatgatgttcgttttagttctgcttgctaaagctgaatacggctatgcttctaccagacgccttgaacgtctttgtaaaactgatattagatatatgtttatcgctaagaatcagtgtcccagccatatggctttccaaagattcatcaatgatgatttaaagatgtctatcgatgatattttttatgaaatcaacaggtatattgtaaaaaagatgaatatcaatactgatgtcctatgtatcgacgggactaaatatgaagccaatgctaataaaaatacttttgtttggcgtgctaatacgatcagaaacagaactaaacgctggaaaaagactaatcagtgtattgacagaatcaatagatattttaagaaaaataatatcaatctaagatattcattactaaaagagccaagtatcgattatttattgaatatcagtgataggatagaagaatacatgaaagatgaagatattgattttgtacatggcaggggcaaaagaagaagtgatattcaaaaattatatgatgaattaaaagaacacgcgatgaagatgtttgaatatacaattcatatggacattctgggagaaaggaacagtttttctaagacagatcctgatgcaacctttatgcatatgaaatatgattattataatcatacaaatgtatttaaaccgggatataatatccaaataggcgtgagcgatggaataattagaaatatttatatcagcagtgacggtaatgatataaatacatatataccatttatggaaaaatatcatgaagcatatggatgttatcctaagaaaacaccggctgatgcaggatacggaagttatgaaaattatgcatactgtaaagaacataatatcgagttgtatatgaaatatagtggatattacaaagagaaagaaaaaacaaatgataaaaacagatttaaaaaaaaccatatgaaaaggacagaagaaggaggattcatatgtccggcaggacatgaatttgaattagaaaaagtcacaattgatgaacgaagtgattatgagaaattaaattttctgtttagaaataaaaactgtgaagggtgtccactaagaagcagatgtacaaaatcaaaatcaggacgaacaattaatcataactaccagttagaggaatatcaaaaagaggtcagagagaatctggaaagcgaagaaggaaaaaaactaataaataagagaagctgttattcggtgaattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttatttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcactgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggtgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactattccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataatccaccgaataacattcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaacagtgaaaaaatagcctgttatatgaacagtattattgatggattgacgatagcaaaaggattaagtataataagcgctcatatagcacaataccaagcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattatcataactaattagtcaaaataatggaaaaagccagttaaaataatttgataaattctagttaatataaagtgctaaataacaagaagcagtgaaacagaaggaacatttggtgatataaaaacaaatcagggatatggaagattacgacggaggggagaaaatggtgtaaaagaagagatactgttagtcggaataggacataatctgaggaaatatcacagatataaacaaaaaaacaaagaatacgaagaaaaaaaatcaataagctagaaatttaaaaaaaaaaagaaagctagttctttttaagtgcgtcaaaaatacctgaaagtatccaagtaaataaatatttggatatttttttgttatgaatgaggagaaattaaaaacgggacataaaaaaagcgaatgaatagccaaaaactattcattcgttacagcccctttttttagggtatctaagcttaattgttgaggtaaatatttattgataaacaatttggataatgatagagatgtgtaaatgctaaatataaagaagttatagttatatattttttggagcattataattgctgatttagataattaattatgagatataagataaaatcgttatattatttttataaatgttttatagtaaatttttatcgataaatggcaatattatttaatagggaatgtttctatagtctagatattaaaaaatattaattatttttaaatgtaattgatttttatgataaaaaggcataatatagttcgtgaatatattcattagcataattagagcaattttcatataaagatggtataatgatttttagggagtaggtgagggtatgaagaatagaataattatgattgtattagctttttttgccttagttaatataatattagttgtttgtgcttttaatatcacacctttaactattagaagagatacgttcatatatgaatatggtagtgaaatacaaacctcgccacaatattacataaatgcaaatgaggctattttatcacaggttgtattgaatttttctgatttaaaaaatgaaatagggctttataaagtttctgcaacttatttaggggtagaatatcctttttatataaaaatagtagatactacaaaacctgttgttacattaaaagcatcaacttttaatgtagctttaaatacaagagttaatgcaattgatttaattgaggaagtagaagataattcaacgtatactgcatattttaagggtgaaggagaagaaaaagaaacatataagatatttactgaaaaaggatcgtatgttgaaagaatcattgttgaagatcaagctggtaatcagtcagcctcattaagggttaagattgtagccggacaaaatggaaataatccaactttaacaggaatcgataatattgagattttaaaaggaagtagttttaatgccttagagggagtagaggctacggatggtagtggtaataatattactgaaaaaataaaaattttaaaaaataatgttaacgttaatgaagttggagaatatgaagttatatattcagtaactaacgataagggacatacacttcaaaggaccagaagagtaacggttattcaatcagaaaaggcggggcgttaaatgataactaatttaattattttaatttgtattattatatttataattattaattttattgataaaagcgacgataaatcatcattggcaatcaagtatggggcattttatatgcctagaattgatgtgaaaaaagaatattggcgttttattactgctaattttgttcatattgatattgtgcatatatttatgaatgtatatagtatatattatttagggggaagattttttgaaccgcttttaggatctggccaatacttttatttagtattaattagttgcattgcaacaagtggtgcttgttattatcaagggaaaaagtttattaattcatataatacgattacattaggagctagtggtattttttatggttttttaggtgcgatgatatcattaggaatatttgttggtggtgatttttatatgctattaaaatcgtatatgtatattattgttattaatattgcttttacatttttaaatggtcgtgtatcaaaagccggacatatcggaggtttaataggtggttttttggcgatgacaattttgattggttgtaaagcatggctgttttagttgatggtgatgcttgtccagatcttttagaaataaaaaaattagctaaacgttatttagtggaaatgattgtttttattgattatgctcattgtcttcaggatgattattttaaagtttgtttttgtgaagtgggtaaagatagcgttgatcaggcaatcataaatatttgtaaaaaaggcgatttagtaattagtcaggattatggactggcaagttatgctttgttaaaaggggctcaagtgcttcatccttcaggaaaagttattaataatgaaaatattgatcaattattgatgggacgttatgtttcggctaaacaaagacggatgaacaagcgagtaaaaggccctgctaaaaggacagataagattcatgatatttttttaagacagttagaaaatatattgatcaataataaaaatgctagttcaaaatgaactagcattttatttaccgctattaccatagtttttaagaactcgagcactaggatcatcaacatcacaattttcccattctttatttggcatccaaaaatcttttacccatttagcttgtccaggataaaatgattcaaagatatcacgatataataatgattcttttgtaaacggagtagcaaaagaatatttttcttttgcgataacaaggtcatcatcattgtataagctttcagcatattcttttaaataatcaaccattgaatgtcctaccgcatctgaaaatgcagctttttctctaaataagatatcatcaggtaaataatccataccttcaaatgcgtgtcttaacaaatattttcctttattataagtattcatttttttaaccggatcaatgctcatagcgtaatcaacaaaatcaatatcagcaaaaggaactcgtccttctaaggcatgagcagaaatacaacgatcagctcttaaaacatcatacatatataattctttaattcgttttttagcttcatcttgaaaggcttgagggtttggtgcaaagtcggtatatttataaccaaataattcatcactaacttcacctgtcataattactttgatatcagtattttcgtgaatgtatttgcataataaatacatcgccatactagctctaatagttgtaatatcatatgtttctaaatgaaagataacttctcttaaattatttagtagatcttgtttggttatgattacttcagtatgttcagtacctaaataatcggcaacttgttttgcgtattttaaatcgataggatcactttccataccaatagcaaaagttctgattggcttatcgtttaatttagaagctatcgcacatactaaagacgaatctagaccaccgcttaataaataaccgattggtgcatcagacatgaatctttttttaacggcactttctaattttgtttttaattttatagcgattgtatctaaatcgtcattgttaatgattttaggatcacttaaatcattataacagataaattttccttctttataatagtgacctggtggaaaaggcatgatatcttcacacaatgaaaatagacttttagcttctgaagcaaaacaaatttttccatcaactttgctgtaaccataaaacattggtctgattcccattggatcgcgagctgccatgatttcttttttctcattgtcatagattactagtgcaaattcagcatccaaaaatttacacatgatttctaaaccatattttttatataaaggaattaagatttcacaatcactaccagatttaaaagtatattctttctctaacattatttttaaatcagggtaattataaatttctccattacaaacaagtacacagtctttataagcaaaaggctgatttccttttgaagatagatccataattgataatcgattaaatccccatgttattccctcttttatactaacatgctggtgatcgggtccacgataagccgcttgatctaatgcgtcattaaatacctccaatttaaattcttcatttccgactactaaaaaaccacacataatatatttcccccttaaaattgtatagttgcgagaatagaaaaactcgcttaatgtcgcgagtacccagataactaaatagttttaatagttacatggtacggaaaatacttcatagagtactcgatacccgccaatagtaacgttactggtaacgttctagcctacttgcatatgctttcggtagacagctcataggtgttcttcataataaactcccctgctaggctcacaccatttcccagctcgctgtaggttctgtaaattactactctcctaatcattgcttttaattactattactaattgatgttagtatataatatttttttattaaatgcaataaaaaaaagttaatgcgataatattttttatgcaataataaaaaaccatcattagatggttttacaaacatcgatccatgaagcatttacatacttttgtaaatcttcaattgttaattcaattgcactgttggaactgccacaggcgggaaaaacggtgttaaatcgcttgagagattcatctaaataaacagtaacattagggttgatgccaaaagggcaaacaccaccgacatcatgaccaattattggtaggacttcatcacgtgacagcattttagctttagttttaaacgtttctttatatttatgattatcaattttcatgtctccagcagtaacgatcaaaatggcttgatcattaattttgaatgataagcttttagcgattcttcctggaatacagtttaaggcttgagctgcaagttcgacagttgcgctagaaacatcaaattcgattatatcttgatcacgatcaaattgttttaaatatttttttgcttgtatgagcgacatatattgatacctccaattttataatttctaagaaatattatagacaagaatttattgagaattcaaggctttaaatagtaataattaggttataataatagtatcaaatatattactaaatatatttgacaaaatatctatcttttaataaactttgagtatattgagaggtagaaaagatgacatataaattaattgcgttggatttggatggaacgttaaaaagtagtgataaaaagattttgcctaaaacaaaagctatattacaaaaattagcgaaacaaggtgtaatattggttttagcttcaggtcgtcctacagcggggctatatgctgaagcaaaggaattagagttggacaaaacaggtgggtatcttttatcatttaatggagctaaagtagtggattatcgtactaaaaaaactatttatcaaaaggtatatgatgccaaaacagctcatgcagtatacaatcgtgctaaaaaatacaatttggcagtaatgacttatactgatgaattgattttgacagaagatgataacgataaatatgttattattgaaagtgaagttaatcatatgccaataaaacatatcgatagttttaaagatactgtagatttttcggtaaataaagttttattgactggagaacctgatcatgcaaaaagaattattgatgaatttaaggagccatatggcgagtctttaagtatttatcgttcagcaccgttttttattgaagtaatggcgcagggaattgataaagcagcttctttgcgaatgttaattgaacaacttggtattaaacaagaagaggtaattagttttggtgatggatataatgatttgagtttgattgaatttgcaggtatgggcgtagctatggctaatgcagttgatgaggtgaaacaacgagcaaattatattactttatctaatgatgaagagggaatttatgaatgtttaaaaatgttgaacagaaagggtgagatataatgttgccaaatgatattaatatgctggtaagttttttgaatacgaaattaagggatgatgatatgtctctagaacatttattagaagttaatgatgctgatcgtgatgaagttatgatgcgtttagaagcaaatagtttttattttgatgaagcaagtaaccaaataaaggcgaagtagagcaaatctttagggtttgcttttttgaagcttgatttagcgatagttaaaaaatatattttatattagctagaaatggaattaaacattattttattttttgataagaaatgctataatgtaatttaattaagggggatataaaaaatgttaaaattagaagattttaaagctgccaaaaaaagagtagatgaagtaattgaagaaacccgtttaattcatagtgaagctttttcagcagaatgtggcaatgatgtatatattaaaccagaaaatctccaaaaaactggtgcattcaaaataagaggagcttataataaaattgttaaacttgatgatgatgctaagaaaaaaggactgattgcttcttcggctggaaatcatgcacagggagtagcttatgctgctaaaatgttaggtgttaaagcaactatttgtatgcctgctcatacaccattaataaaagtggatgcaacaaaagcccatggggcagaagttgttttacatggagaagtctatgatgaagcttatgctaaagcggtagaattacaaaaaagtaaaggatatacatttgtgcatccttttgatgatgaagatgttattgaggggcaaggaaccatagcgttagagattttggaagagttaccaaatactgatgtaattttagtaccaattggcggtggtggattaattgctgggattgcctgtgcggctaagcaaattaatcctaatgttaaaatttatggtgtggaacctgaaggtgcggcaagcgctttggctgcaatccatgaagatcgggttgttactttggctgaggctaatacaatagctgatggaacagcggtaaaaacaattggtaataaaacttttgaatatataaaaaaatatgttgatggaataattacagtaaatgattatgagttgatggatagttttcttttgctggttgaaaaacataagatggtagctgaaggttctggtattttatctttagcaggattgaaaaaattatatgagaagaataaaaaagttgtttcattgattagtggtggaaatatagatgtaatgacaatttcttcaatgatcaataagggattaatatctagaggtcgaatttttactttttctgttcaacttcaagataaaccggggcagttagaattagtgtctaaagtattaaatcagtgcaatgcaaatgtaattgctgttgatcataaccagtttaaaaattttgcacgtttttctgaagtggaattaagggttactgtggaaactaatggtaatgcacatattcaaacgattattgatgaatttgataaattaggatataagattactaaaatcaattaagcttgatagggtgaaatgcttatgcattttactctttttttattatatttagatagacaaaaactcatcaagaatatagatgagttttatcaagaatgcacttccatgttatctatttttgtttaagagtttcaaattcttcatcgtaagcatattcaaatatcacatttaactattttttgtttgattaaataattcattgggcatgatcgatacgatattctaatatatattcttctttttatgatgttattgccagtatttagtagttgttatatttaaatctacattaccagttatacctttgatagaacctgtttcactatattggaggatttgatattcatcttcgataataggatcattattgtagcgggctttccattttatatagtcatttaattttttatcggtaagttttgtcgtccaccagttatggtttgcatagattccttttttattttgactaggaatgttttctaaaaaagtggttgcaacagtagttaaagtatcgttagataaatcttcttgaaactcttcatcctctaaatctatgaaaacacctaaatcaggtactttattatctaataatgaagttacaaaatcagcttctttttttgcttgaatagcatcttgagcgagcgaataataataaacgccataaggaatagataattcttcacattgtttaacgttttgtttaaaataaggatcttctttagtttttgtgccatcagttaaagaagtataaccacaacgaataattacataatcaatttcttgactagctagctgaagatcgacttcttcattccattttgaaatatcgatgccaatatatttaccttctgtggataatttatcattatgattaaatattactattccagaaattaataaacaacaagataataatacaaaaacagctttaataagagattgcttttttttatatttgttaaataaaatcggaaaacaaaagaacataatgattaaaaatattataatactatgcatcaaataatcaggtaaataacgtttataataaagtgaacatgaaaaaacgataatacttattaatataaagaaaagagtattttttttattgaaaagtttttttgacttcttttttttcattatatcacctcgacaacatgattttaacatagttgtcgatataaggcgatatcttatttttgatttactttttctaattcttcgataattaagtctaatttattatgaaggtcttggataatgatttcggtttttaaattaactttgtaatcattttcatttctttgacgatctttttgttcctgacgattttgtgccatcataataattggtgcttgaatagctgctacacaagaaagaatcagatttaaaaggatgaaaggatagggatcgatactgttaggtgtaaataaattaaaccacatccatgctattaatagaattataaaaataataataaaactccagctgccacctagatgagcgattttatctgcaagtttttggccaaaagtttccttttcttgtttattgtttgcaataggtttttcgagaaccagatgaattatctcttcatcttgcatatcatcgtgaacattttcgagaatttctttgattattttattatgagttaaatttttcattgaatcaccctataattagtatttaccataagttttattttagacatatttaaaatataaatgaaattttttgtagcaataaatatttattaatttgttgaatttaataatgttgttatgtacaatattatagataaaagaacgaagggaagataatgatgttaaaagagtattttggtaagttaaattttaatcattttcaattcttttgtagttctattttttgtgattaacatatcaatattgatatgttttttttaagaaatttaaaaggaggacgattatgccaaagagagaagatattaataaagtactagtaattggttcaggaccaattattattggtcaagcttgtgaatttgattattctggaactcaagcttgtaaagcattaaaaagtttaggatatgaaattgttttggtgaattctaaccctgcaacaattatgacagatccagaaactgctgatgttacttatattgaaccgttaaatttagcgagattgacacaaattattgaaaaagaaagacctgatgctcttttacctaatttaggaggacaatcggcattaaatttatgttcagaattaaatcaagcaggaattttagaaaagtataatgttcaggttttaggggttcaagttgatgcaattgaacgtggtgaagatcgacttgaatttaaaaaagcaatgaatgctttaaatattgaaatggctcgaagtgaaatcgctaatacagttgaagaagctttagatatcgctgataaattaggatatccagtagttgtacgtccggcttatacgatgggaggagccggaggtggacttgtttataatgttgaagaattaaagacagtcgtatctcgtggattacaagcaagtttagttaaccaatgtttgattgaagaatcaattttaggttgggaagaattagaagttgaggttgttcgtgatgccaacaacaatatgatcacagtttgttttattgaaaatattgatccattaggagtacatactggtgattccttctgtagtgcaccaatgttgacaataagtcaggaagtacaagatcgtttaaaagatcaggcctttagaatcgttgaatcaattggcgttattggtggaacaaatgttcagttcgctcatgatccagaaactgatcgcattgttgtaattgaaataaatccaagaacttcacgttcatctgctttggcttcaaaggctacaggattcccaattgcgttagtttcagcaatgttagcagctggattgactttggaagatattccatgtggtaagtatggaactttggataaatacgtaccagatggtgagtatgtagttattaaattcgctcgctgggcatttgaaaaattcaaaggtgccgaggataaactgggaacacaaatgaaagctgttggcgaagttatgagtattggtagaacttataaagaagcattccaaaaagcaattcgttcgcttgaaataggtcgctatggtttagggtatgcaaagaattttaacgaattatcaaaagaggaattattaaagaaattaacaattcctacaagcgaaagacaatttattatgtatgaagcgttaagaaaaggagcaacagttgaagagttgtttgaattgacgcaaataaaacattatttcattgaacaaatgaaagagctagttgaagaagaagaaaatattatgacttatagaggtaaagaattaccaatcgatgttttgaaacaagcaaaacaaaatggtttttctgataaatatttaagtcaaatattagctgttgaagaagatgtgattagaaaacaaagattagctaatggtattgatcaagcgtgggaaccagttcatgtaagtggaacacctgatagtgcatactattattctacatataatgctccagataaaagtaatattcatactgataagaaaaaaatcatgatcttaggtggtggaccaaacagaattggacaagggattgaatttgattactgttgtgttcatgctgctttagcattaaagaaattaggttttgaaacaattattgtaaattgtaatccagaaactgtttcaactgattacgatacatcagataaattatattttgaacccttaacattagaagatgtattaagtatttatgaaaaagaaaaacctgttggtgtaattgctcagtttggtggtcaaacaccattaaacctagctgcacagttaaagaaaaatggtgttaatattttaggtactacacctgaaacgatcgatatggctgaagatcgtgacttatttaatgaaatgatggaaaaactagaaataccaatgccagaatcaggaatggcagtaaatgttgatgaagcgctagaaatagctcaaagaataggctatccattaatggtaagaccttcatacgtattaggtggtcgtggtatggaagttgtttatgatgacgaatcattaaaacaatatatggcagcagctgttggggtaactccagatcgtccaattttgattgatcggttcttaaataatgcaatggaatgtgaagcagatgcaattagtgatggtgagaatgtttttgttccagcggttatggaacatattgaattagctggaattcattcaggagattcagcatgtattttaccatcaaaacatattccgatccgtcatctagagacaattaaagagtatactaagaagattgctagagaaatgaatgtacgtggtctgatgaatatgcaatatgcaattgctgataataaagtttatgtattagaagccaatcctcgtgcttctcgaacagtacctttagtatcaaaagtatgtaatattaacatggttaaactagctactgatatcgttactagtgatttaacgggacgtccttcaccagtaacgtcattgacagaaaagaaaattccacatattggtgtaaaacaagcagttttcccatttaatatgttcccagaagttgatccgattctaggaccagaaatgcgttcaactggcgaggtcttaggacttgctagttcatatggagcagctttatataaggctgaagaagcaacaaaatctattttaccaacagaaggaaaagttttgattagtgttagtgatttagataaacctgaagttgttgaattggcgcaaggatattatgatgctggttttacaattgttgcaacaggtaagacgtatgaattgattacagaaaatggtattccggctgaaaaaatcaaaaaaattcatgaaggtcgcccaaatattgcagatgctttaacaaatggtgaattagcaatggttatcaatactcctgatggaaaacaaagtgttcatgatgatagttatatcagaaagtcagcaattaagatgaagattccatatatgactaatattgcagctgccaaagcttcattggaaggaattatggaaatgaagattcatggtagtcatgaagtaaaatctttacaagaatatcatgcggcaattaaataatattttataaaatgtagtcattaatttgactgcatttttattattttgataatctggataaatttattattaaaaactgcatttatcaaatgatataattttgtgtataatattattgttgattaagctaaaggaagctggtgaaaagtaaagttattataaatttatatttaatatcacaaattaatgaattaaaatttggtatattataaagctaatgctgttatatgggggtatatatgaaaattataaaaattataatcatttgttcaatgctattaggtctaactgcatgtaataaaagtgatgattcagatatatcaacttcaaaagaagctgttactgaaaatgaagaagaaattacagaatatgaaagagatacaacagctggagagattaaatacataacgcttgaagagatggaagcgatgattgagaaaaaagaatcttttccggttattctttcaactacttactgtttatattgtcgagactttcattcagtatttgatgaatatataaagacgcatcatgtcgttatgtatgaggttgttcttgataatgaaaatcgcagtgaacaagaaaacttagcaattataaaaaaatattttcctgaattttcaactacaccaggtgtgttttatgtagaaaaagggaaagaaaaaaattatcttaatttatcatcaacagggatgaatgaagaggtaattgataattgggttcaaacatataaattagataagaaaaaataaacggttaaacagccgttttttttaatgattatttaagaaaataatcttattttaatatttttaaaatattgttatgataaattatatacgcgataataaaaaaatataaaaatatcttgaataatcccttcttttctactatactatacaagaaaagaaaggaatgaggctgatggtagtatttaaggaaagtaaaaaagtgaatcaaaaagccttattttcatatttttgttgttgttagacatatcatttctgttgatatgtttttttatagtaataaaggaggataactatgaaggcatacttaatattagaagacggtaatgtgtttgaaggcagaagtattggagcaataaaagaagttgtgagtgaatttgtttttaatacttcaatgactggatatttagaagtattgacagatccttcttatgctgggcaatctgtcgtaatgacatatcctttaattggaaattatggtgtttgtttagatgatcaagaatcatataaaccgcatgttgaaggatttgttgttaatgaacttgcaaggttaggaagtaactttagaaaaaatattgaacttgaagattatttaaaacaacatgatataccagggattcagggaattgatacgcgtaatttaactaagatcattcgtagtaaaggttgtatgaatggaatgattacaactaataaatacgatgatttgacagaagtaatgaaaaaaattcatgatttcaaagtaactggtgtagttgaaaaaacaacttgtaaagaaagttatatacttggtgatgggataaagaaagttgctttgttggattatggagcaaaagcaaatatagctaaaagtttagttagacatggctgtcaggtaacggtatatcctgctagtactactgctgatgaaattttagctaacgattatgatggaattatgttgtcgaatggtgctggagacccatcagaaaatgtccagattattgaagaaatcaaaactttggtaaaaagcggaaaaccaatttttgcaatatgtttgggacatcagcttatggctttagcacatggttttaaaacagaaaaaatgaaatatggacatcatggtgctaaccatccggtcaaagatttaaaaacagggcgagtatatatctcaacccaaaatcataattatgtaattaaaactgattcgattgacgaaactgtagcaagaccatggtttatcaacgttaatgataaaacgatcgaaggcttagaatatttaaatgaaaatattaaaacagtacaatttcatcctgaagcatgtgctgggcctttagatacagatgcattatttgaagagtttataaagatgatggaggtaaaataagatgccaaaagatagtagaataaaaaaagtattagttattggttcaggcccaatcattattggtcaagcagcagaattcgattatgcgggaacacaagcttgtcgtgctttaaaagaagaaggggtcgaagtagttttaattaattctaacccagcaacgattatgactgataaagatattgcagataaagtttatattgaaccattaactgttcctgttgttaaaaatttaattattaaagaacagccagatagtattttacctactttgggtggtcaaaatgctttaaatattgcaatggctctagctgatgaaggttttttggaagaacataatgtacgaacgatcggaacttctaccgatacgattaaattggctgaagaccggttagaatttaaaaatctgatggaacaaatcaatgaaccatgtgcagcttcaatcgtagttaatcacgttgatgatgcaattgaatttgcccaaaagatcggatatccggtagttgtaagaccggcttatactttaggaggaactggtgggggaattgctcatgatgaacaagaattgcatgatatttgttctaatgggttaagactttcaagagttagtcaatgtttaattgaaagatgtattgcgggctggaaagagatagaatatgaagtaatgcgtgatggggctggcaattgtattacagtatgtaatatggaaaatttggatccagttggtgtacatactggtgatagtatagttgtagcgccaagtcagactttatctgataaggaatatcagatgttaagatcatcagccttaaatattattacagctttaaatataaaaggtggttgtaatgttcaatacgcattaaatcctaatagttttgaatattgtgttattgaagtaaatcctagggtaagtcgttcttcggctttagctagtaaagccactggttatccaattgctaaattagcggctaaaattgcattaggatataatcttgatgaaataattaatgctgttacaggtaaaacatatgcttcttatgaacctactttagattatattgtttgtaagattcctaaatggccttttgataaattcgtagatgcttctagagaattagggactcagatgaaagcaaccggagaggttatgagtatttgcaataattttgaaggggcgttaatgaaggctttacgttcactagaacaaaatgtgtattatttgtatttaaatgatcttgaaggtaaagatcaagagtttttgcggaaaaaattgaaagatgttgatgatcaaagaatttttgcaattgctgaagctttacgtcaaggaattagtgaacaagaaattcatgatattacaaagatcgatgtgtggtttattgataaaatcaaacatttgattgaagttgaaaatgaacttaagaataatgaattaacggttgaattattacaaaaagcaaaacgtttagaatttcctaatttagttattagtgaattaacaaataaaccgataaatgaaattaaaacaatgtgtaaagaaaatgatatcactgcagtatataaagtagttgatacatgtgcagctgaatttgatgcaacaactccgtattattattcagtatatgggggagtaaatgaagttgatccagctgatgataagaaaaaaattatggtacttggatcaggtccgattagaatcggtcaaggtattgaatttgattactgttctgttcattgtgtttgggctttaaaagaagctggatatgatacgattattgttaataataatccagaaactgtaagtacagattttgatattgcagatcgtttgtattttgaacctcttactcctgaagatgttgaaaatattgttgatattgaaaaaccagatggtgcaatagttcagtttggtggtcagactgcaatcaaattaactaaagctttaatggaaatgggagttaagatcttaggtacttcagctgatgatgtagatgctgctgaagatcgtgaacggtttgatgaaattcttgaaaaatgtcatattgatcgaccacgtggatcaacagtatttacgattgaagaagcattggaagttgcaaataaattgaaatatcctgttttagtaagaccatcatatgttttgggtggagcaggaatggagatttgtttaaatgatggtgatgttaaaaaattcatgaaaattattaatcgccaatatcaagaacatcctatattgattgataagtatttagctggtaaagaagtagaagtcgatgctatctgtgataaacatggtattttaattccaggaatcatggagcatgtagaacgagcaggagtacattcaggtgatagtatttcagtttatccatcacaaaaaatcaaagagcacataaaagaaactattgttgaatacacaaaacgactagctaaagcattaaatgtaatcggcttgattaatattcagtttattgtatatgaagatcaagtttatgtaattgaagtaaatccacgttctagtcgtacgattccatatatttctaaagtaacagatattccggttgttgatgtcgctacacatgtaattatgggaaaatcaatcaaagaacagggatatgagtatggtttagcgcctgaaaaagaaactgtcgcgattaaaatgccggtattctcgtttgaaaaaatcaaaggtgctgaaattagtttaggaccagaaatgaaatcaacaggtgaagtcttaggaatttctaaagattatgacgaggctatatataaagcatttattggtacaggtattaatttacctaagaaaaagaatatcatttgtacaattaaggattcagcaaaagaagaatttttaccaatagcaaaacaatattacatgtttggatatgatttatatgctacagaaggaacttataattatttaaaagaacatgatgtaccagttagtttggtaaatcggatcaatgctaaaaataatactttatttgatttaatgctgactgataccgtagatttgatcattgatattccgacaagaaataataatttaaaagatggctttttgattagacggtttgcagttgaagctggaattccaatttttacttctttagatacagctcaagcactaattacaagtttggaaaaacgtcataaaggtgatacgtcattagtagatatcactaaattgaagtagtcagttaaatttaaataaaaagtatttcaaaaactgtataatcattaaataaaagacaggtagatcctcaatatataggatttacctgtttattgttagctaaaagtatataaatattttgattttaaattctattaaatatgttattcataagataaggatgcaagaaaaaatgatagtttgtatgtattttaaagtagataataaaaaagacatcttattgattattacacaatcaataaagagtcttatataatattaagaagtttttaatatatttataaaatattcattatgttctattgccttaaatactaaagcgccaatgatcaagacaattaattcaccgatcgctacgtataaagcattgattagatatggaatttgataagcataccaaagttcaccgccaataatcaatcctgtaattatagcacctataatagcagctaaatatctgtttttaattacatacatagtaatgcagacaataattgtactgatcgttccaaaaattacatctagtagtcccatcggtgaaaatagattagctataatacatcctattattaagccggggatgtattttttattataaaatgctaaaaaaaccatgatttccgataatctaaactgaatttcagaataggcaataggtgagattgctaaagtgagggcagcataaacacttgcaatcattgcattgactacaatcagttttactgaaatacttctgttcattatttaattcctttcattgaattattttcacttatatgtcacctcattgaaaacaaagttattatagctgaattgtttataaataaccatataaattttaaaatatggaaaaaaatttaataatattgagatattttaaatagatataaaatttttactactaatgataaaagatcactagttaataacccagtgatctttgttgattattgctttttatactgttatttaggtgaatacgcaggtaagtaaaattgtgcagtcattgtcataacatagcaataacaattgtttgctcttatcaaaacttttttagttaaagttctgttttttggattaactaatttcataattcataattccctccatttccgtccgccttcgtcggtcagacacaaacattttattaaaaataattctcatccaatcgtttttgtagtatcctataagagaggtggtatactacagagcacgtggaggagagtaggcaattctactctatatagaatatcctgaataattataagtcgccgtcagtctttcaagcacaaacaagtaggacttagagcctggacacttaagattgtttttatcaactatagtgatattttgcagactgacagtcaatgccacttctccttttttgaaaggagtttttttatgcttaaaatccaccgttttaattgtgctggtcttgatgttcacaagaaccttatcgtcgctaccattggtatcactgacaagaaaactcatgtcactgaatatattcagaaagatttctcttctcttaactttgacctctataatcttaaaaactggcttattgaacacgaatgttttgatgtctgcatggaatccactggtaagtattggttccctgtctttaatgtccttgagactgaagctaaaatgaatattgttcttgtccatcctaaatatgtcaaagctatcaagggcaagaaaacagacaagaaagattccaaatggatttgtgatcttttcaagcatgatcttctcaaatcttcttttatcccgcctaaggatattcgtgaattaagggatctctctcgttatcgttttaagctcatctgtatgagaactagtgaacgtaaccgttatcagaactccatgactgtttccaatattggtttggcttctgttgtttctgatacttttggaaaaacagcccaggccgtcatgaatgaagttctatctactgaagttattgatgaagataaaatcacaaaacttattcatggtaagtgcaaaaacaaagataaaatagttgaatctcttaaaagttcaaaaattgagccagatcaaagatttaaaatggcagaaattcaatcacatatgaatgaacttaatcaacatattgaagctgttgaagtagaaatcatcaaacgtgcttccagatactttgatgattttttacatattacagaaatagatggaatacagcttatgtctgccattcttatcatttctgaaattggcgttgatatgactcaatttgaaacagataagcaactatgctgctgggctggactttctcctgccaataatgaaagtgcaggaaagaagaaatcagttcgtatcaacaaagctggacaatatcttaaaccagtattagtacaatgtgcattggcagctatcaaaaacaaaaacagttattttggtcaaaaatatacaaaaatcaagaaaagaagaggacacaagaaagcaatcatagctattgcaaggatgatgcttgtcagtatttatcatatgattcttactggagaaaagttcaatccttcagactatgaatcatttaagaatccaaagccacaaaaagaaaagaacaattatacagttgagacagcacttgattttctaaaatcacagggatttgatgtatcaacaattcaagatattcctaaataatattctgttttttctaaataaaactgaacttgtttttaagttcgtctttttttgtgtttttactcacgattgggttcaattatttttcacacttgctctcctttccaaaaaagatagttaatatctttttttaattaatttatgcatttttcaaaatacattgtttttgaaaattacatagcatgttgaatgtaataatgttttactcatcaaattcattaatcaaagaataattcatttcgtcaagtaaatctggcttagtttctaagatttgataatattcaattaaactattttttgcattagagcgagcgtactgacatgttttatgttttctttcaacgtttatcccatttttatcatagcatgtagaataacaaacatcacataaatgtactgcccaacactcattacattcttttaatgaataataatcatattcatttataaatttgctttgtatacattgttcacacaaaccgtttttaatatccccgaaattaggcgaatcgcctattttttcacatactttaaattttccatctgaagtaacataaagtctaccataaccaggatcacaacatccgtttcgacttaaaaattttattggtaaatcagaaattggtctattttgcatttttataagactaaaagcttctatacttttttcatatcttatattgtcgcatttgcatagttgatttacagcccaatattttataggatcagtactattaaaattttgagaatagaattcttctgtagaaatttctgtatcaaaattggtgtctataccactattttttaaactcccgtaacttacatatgagtatctaaattttattccaggagggaataattcttcactttcaaagaaattttttattgtagataatttatcttgatcataaggaggagtgatgacactattaattgatatgacatcttttgctctttctttgaaggaagaaatcaaatattttaatccggctattgtatcttcaaaactcccttttttattaagataattacgatattgatcatgataaatttttggaccatcaatactgcataaaatatttatatttttcaaagaagagaaaaaatctgcaatttcttttgttacaagtgttaaattagatgtaatagagtaatgaaagtttttggtagtgttaagcttttcacaatactcaatacattgctttattaactcaaattttaataaaggttcaccgccatagaatccaataaataaatcatttccactatgatttatggtataatctataatttttctagcagtatcccagctcatattagagttattgaattcatgaaaatatgagcagtcatctccatagacacaatatttacatctaagattgcattgttgtgttacttctaaaattaattgtttaatttctttgcttttattagtattattcataaatttattataatatggtaattggagtatatgctctgatttatatagtttatatatatttattaatgctttatttatttcttttttttgataatttaataaataaactttttctagattagatgttgaaataagttcttttaatacataatattcaacgtcatcacatgcaaaaacttttccagttcctgaatcataaaaatatttattattttcggtttcgaatgtttgacctaatctagaaaaattattatcgcataagaatttgaatttattaaaaatgattttattgctcatgtgtttatccctcccctttataattaaatggtactctagaaaagaattaaagtcaattcttttataaaatattattttttataaagtattatttttaaattgttatagagtattgtataggttattaaatttagtatttattaaaaatgaagatatttactaatttattaattttaataaaaataggtattaaaaaaggtatagagtaatatatatgttgtgtaattacaggtttagccggtgttttaatgaaattaacaaaaacaatttgttataatcaataaaaaagaaaaaattttaaaaaaattataattttattatcaattatcacaaaaaaatattataattataaatgaggttcttaatatacacttatttactgatatataaagtttaaattagttttttgaatttgcttgtataaagtgttaaatatttaatgttttttgcactttttgggattgtacaagtagaaatacttaaaaagataaaaacataaataaaaagtacaaagactagtttgatagatattggtaaaatatatggtgtaagattaaagggcttacaattaggtcaagcgaagggaggaatttatatgcctaatatagttctaacaagaatcgatgaacgtttgattcatggacaagtagctactcaatggtctggaagtgttggggcaaatttattattagttgccaatgataaagttgctgaagatacatttagacaagggttaatggacatggctgctccaagttatgcacaaacacgttattggacagttgaaaaaacaattaatacgattcataaggcagctgatcgacaaatgattttcatcatttgtgataaccctcatgatgttttacgattagttgaaggcggagtaccaattaaaaaagtaaatattggtaacatgcatatggctgatggaaaacgtcaagtagctacatctgttgcagtaaatgatgctgatgtagcagcctttaaaaagttgatggatttaggggttgaattggaaattaaacgtgttccagatacacctgctgaaaacattgacaaattatttaaataggaaaaggaatctgtataacagataattgaaaggagaacgaacatggaggtaaacattatccaagcattattggtttttatcgttgcgtttatcatgggtattgaccaatacagtttcttggaatcattgtatcaaccaatagtaacatgccctattattggagcaatcttaggagatttccaattaggtgttgttgttggtggtgcgtatcaattaattcagattggtagtatgccaatcggtggggcacaaccaccaaatgcaattttaggtggaattatggcaacagttttcgcagtttctttgggaatggaagcaactgctgatggtgtaggagctgcaatggggttagctattccatttgcagtattcgggcaatatgctagtactttgacatttacaattatgtcaggtttaatgtctaaagctgatgaatgtgcagctaatgcagatgtaaaaggtatccgtaatattaactttattgaaatgggaatcttaggggtattatttggtgttttagccgtagctggtttatatggtggacaagctttaggaacaactttaaaagaattctcatttgaatattcatgggtaatggctggtttagatgcagctggtggagctatgaaattcgtaggatttgctatcttaatgaaagttatgatgtcaggagaaatgtggggattcctacttgcaggttttgctatggcagtaatctgtagtgcaattccatctatttcaggtgcaacattgttattatgtgcatttgttggtgtcgcaattgcaatttatgacttcttaattcatacaaaaattaaaaataatgtaggaacaaatacaggaggtgagtctgatggcatataatattcctgaaagatatcaagatttaacgccagctccaaagttggataaaaagactttaaataaaatggtttggatgtcatgtttcttacaagcatcattcaactatgaaagaatgcaagctgctggttggttatggggtattttaccaggtcttcaaaaaatccatacaaataaagaagacttaaaagcttctatggctcacaacttggacttcttaaatactcacccattcttagtaacattcgttatgggtatcgttttatcattagaacaaaacaaagctgaaacaagcactattcgttctgtacgtatttctgcagctggaccattaggtggtatcggtgatgcattattctggttaactttagtaccaattgttgctggtttaacagcaaacattgctatggatggttctattcttggagcaatcttattcttagttattttcaatgctgttcaatttgcagttcgttggtggttaatgcactggtcttatggattaggaacaaaagcagttactatgcttacttctaatgcaaaagaatttactcgtgcagctagtattttaggtattttcgtagtaggtggattaattgctacttatggttcaactactgtacgtttatatgtaggagatcctgcaatcaatattcaaggattattagatggtgttttaccaaaattattaccattattaattactttaggaatctatgttttaattaaaagaggatggactcctgtaaaatgtatcttattaattcttgttgttggtatcgttggatgtgcattcggtatcttctctggtgattctaaagctatggatgctgaaggtaatactatcccaggtggatatactccacttgtagaatggtatgaatatcctactgaaagtgaataattagatatttaatatcaaaaattaaggggtatggtcaaattgatcgtgccctttgtttttataataaagaggagtgaactattgatatgaattcaattacaatggcagttatttttatattgttccttggcttttttgcttttcaaatagtaaagaaatttttacttaatagtcttgatagttcaattagaaagaaagattatcagctcactgaaaagttgtctgatatgtcaatatcaagaagatttttaaaagattatacttgtgacttatataaaatcaaagcttattatttagataaaaacgttgaaaaatttgataaaatgttggaatatatcattaaaacggattataataatccagaagataaaaaagcttttttggaattgtattatcatacttttatacttaaggaaaataagaaatatgctgatattttactaaaagaaattagtaaatctgaagataaaaattttgttaaatataatcagcaggcatatgaagttatgattaataagcgtaatgatttagcagaagaaatggataaacaaatcgattcaaaaaagttttatggtttttctttaggtgtgattttatatatgattgctattcagtatgaaaggttagaagatagtaaacgtgctattacatattttaaaaatgcaatagtttgtttcaacccaagggaaaagtatagtatatctgctaaaaaacatattgagcaattagaagctaataagtaatagtttattctttttgggaggttaagatgaaatataaagcggtaatttttgattttaatggaacattattttacgatacaccatttcataatattgcttggcaaagagtgataaaagagataactggtagagatttggatgatgaattaagagttaagatgcacggaaaaaataataaggaaattttgtattgtatcaaagaagacatgaatgaaaaagataatgattattattctaaatacaaagaagaagtgtatcgaaatatttgtttagaacatccagataaactgcatttaataaaaggagcggttgaatgctttgattatttaaaaaaacaagggattccttttactattgctagtgcatcaattaaggaaaatattgatttttttgttaaaacttttgagttagaaaagtggtttgatgttaatagaattatctatgatgatggtaagcatgttgataaaattagcatgtttaaagatgctgctaaaatgttaaatactgaaatagaagattgtattatatttgaagatagtaaaactggaattggatatgctaaagaaattggtacaggattagttgtaggaattggtgatgattttgcaatgttaaaaaattatggtgctgatttttgtataagtgattttactgaatttgaatgtaataaatatttataattaaaaacaggaattttcctgtttttttataaaatgttggttcattttgaaaaataatacaaataaaggtagagaactaaattaactaaaaagcaataacgaaagcaaaaaaatcggcaataaaaattataattattcaaacataatctaaaataaaaacagtacaatttcttgtaccgttgtaaaatattattaactaattttcattttataaattctatatgcttattaagctttattcacgctaccaacaacatacattttagacattacatattttttaacttcttcacgtcctaatgcacaatatttctttggatcgatagtatcagggttttgagctaaatattctttgactccttttgaaaaggcaattcttaaatcagttgcataattcactttacaaataccacgttttacacactcgctaacagtttcatcaggaacacctgaagtaccatgcagtaccagtggaattgaaacaacttctttaatctcactaaggcgatttaaatctaattttggttctcctttgtatactccgtgtgctgttccaatggcaacagcaagtgatccgacaccagttttttctacaaattctttagcttctaacggatcagtataaccaccatctccaccatctaaatcatcctctttaccgcctactttacctaattcagcttcaacgcttactttagaaggattacaagcatcaacaactgctttagtaaccttgatgttgtcctcaaaagattcatgtgatccatcgatcataattgaagtgtatcctactcttaaggcttgcattgcaagttcaaaactatttccatggtccaaatgaattgcaactggtacacttgcattttgagcagcaacttttgcatttgcatagaaataatctaaactagcatatttaactgttgatggtgttgtctgcataataacaggtgattttaattcttcagcagcttcaacgaccgccatgaccatctccatattttcaacattaaaagccccaattgcatatttgtttttttgagcgttcaataaaatttctttagttgtaactaatggcatatttccttcctcttttcttaattaattttcacctcgattataccacaattttttcttttataataataatttgctaagatatttgatttatcacgatttagtattaaaactatctaaaaagtgcaaaataatttttaacaattctaaatactatttaaaatataattgttattatattgacgaaaggagataaagataatgaatactaatccattaaagaaacttgtaactcttcaaaaagaaggtaaagctgttggaatttattcagcatgcagtgctaataaatatgtaattgaagctactttaaaacgtggtaaacaagataattcttgcgtattgattgaaagtactgctaatcaatgtgatcaaaatggtggttatactggtatgacaccattggattttaaaaactttgttttaaaaattgctgaagaagttggttttgacaaacgtaagttattccttggtggggaccatttgggaccacttacctggactgaccttaatgaagaagaagctatgaaaaatgcaactgagttaattaagcattatgtaggagcagggtttaccaaaattcatattgatacaagtatgaaggttaatgatgatgatccagatactcgtttaagtgatgaaactattgctagacgcggagcttatttagctaaggttgctcaagacacttatgctgaattattaaaaaaagatcctgatgcgattgctccaatttatattgttggtagtgaagtaccaattcctggtggagctgttggtagtgaggataatggtgttgctgtaacaaaagtagaagattttaaagctactgttgcaacatttaaaaaagcatttttagataatgatttacaagatgcttgggataatgttattgctgttgtagtacaacctggagttgaagaaaaagattctggatgtactgaatatgatcgtgaaaaagccaaagaattaatggcttcaattaaagattatcctaatttgatttttgaaggtcattctactgactatcaaacaaaaattaaattaaaagaattagttgaagatggtgttggtatcttaaaagtaggaccaggtttaacatttgctatgcgtgaagctttatttgcattagctcatattgaaaaagaacttttatatggtatggatgtagaaacaagcaatttaattgacgttttagacaaagctatgttaaatgatgataaatactggaagaaacattatcaaggtactgaattagaaattcgtttaaaacgtaaatactctttctcagatcgttgtcgttattacatgcctctgcctgatgtaaataacgcaattaatacaatgattgataatttaagtacttatggtattccactaaatcttttaagtcaatttatgccaatgcaatatacaaaagtacgagagggattgcttgaaaataatcctgaagaattaatcgttgatcgtattattaatactattgatgaatacttatatgcaactaaccaaaatgaactattataataaaactcattccttataacaatattaataaatttatcaataataactcttttataatagtccatattatttttctctcttaaaaggagctgtacaaataatcaaatgattaatttgtatggtccttttttaataataattaaattttattataaaaaataaaggctgatatgcatttttacataacagccttttgttgtttcgatagtaaaacatatttactagtggccctaataaatacttaaaattatttcattttaactaaagcaattaagtttacaatcacacagtaacaagctagtatacttaaaagtaaactaacaatcaaaatagccatatctgcttccatcatccaggcattgattacaattaagattgcaaaagctagatacagtatagcccttaaaatggcttttctaggttccctggaatcaataattgatttcaacatagtttgacgattctcccgatcaaacttagtagtttgtcttaagctgggtaaaaatttaaatctaaataatatttctgctaccaaacaaaccccaataccagctagcattgcgtgaatccagctagggaagtattcgctacataaaattatcactattaaaattaagataaagcgatttttatatacataaaatttaccttcaacctttgaatcaattaaatatcctttttttgttaatgaatcataatatactgtttgaccatgacgatctaaataaatatttcttcctgaaatattgctcttattgttacctttattttgtgccatcaatcatttcctttcctttacagtatgtttgaatcacttcataatccttatctaaaacaactaaatcaccatcatatccaactccgatagctcctttatgatcatctacatgtaaacatctagctggattgattgtacaagaattaatagctgtatttacaggcactaaagcttcttcgataagaatttttaatccttgatttaattttaacgtagaaccagctaaaccacctgtactagttaaatgagcacttccatctggataaatttcaatctcatttccaccaaagatgaattttgatcctgctggagaaccttttgccattaaagcatcagataccataatactataatttggccctttagaagtaaaataattgtttaatgcagccaatgtggaatggttaccatcacaaataatttcaccatacatatttctaattctatatgctccacctactaaaccattagcacgatgattaaatggtgtcattccattataaacatgtgtcattgaacgtgctccatatgcaaaagctctagtagcctgctcaaaagttgctgcagaatgtccaatgcttactactacaccattttcagcacaatatctagtaagagcaaaatcatcatcagtctctgtagccattgtgatgtatttaattaaaccgtgagcagcttcttgatattttttaaattgttcaattgtaggtttaacgatatgttgttctggttgagcacctttatagatcatatcaagataaggtccttcaaagtgaattcctaaaacctctgctccttcataaccgtcttcaacaacttttgcaacattagctactgcatttgttaatacttcttcactttgagtaatagttgtaggaagcaaagcggtaactccttcactaacaatatttttaagccaatatcttaatccgtcttctttggcatcgttagtatcaaatccatatgctccatgacaatgaatatcaataaatccagggagtatccaattgttaccataatctttatctacttctttttcattataatcgtagataccagcaatctttccatctacaacttcaatttgtcctgaaacaaattgatcagctaaccaaatcttcttactttgaataatcattttatatatcctcctatttattttttgaagttttaaacttcaaatatatcatctataactatattatatcactttattaatttcaatacttatactttttaatttaaatgggtactattttaattattaataaattcaataattttaagcaaactaattttgtaattttcaacaaactaattatcacttttagtttaactattgtttatttaaatttgattgctataatgtggattgtagataatataaaagaaaaggagaagaaaaatgacaaaaactatttttgatattaatgaaactcaaatgggtgaaacaaaaagtacttatactttaactgaaatttaccaacaacctgctacttggaaaaaaacatgtcaacaaattacatcaatgaaagatgaattaaaagcttttattgatcaggtaattactcaagatgattttgatgttattttaactggagcaggaactagtgaattcgtagggaatacactgttctcttatttgaacaaaaaattaaattataaagctaaatcatatgggactactgatttagtagcaactccagaaaattatttatcaagaactaaaccaacattattaattagttttggtagatctgggaattctccagaatctgttggtgcaatcgatgttgctgaagaagtatgtgataacctatatcacttatttgtaacatgtaataaaaacggagctttatcaaaaagagctgctgataatgatcactgctttgctatcaatttaactgatgaaactcatgatcaatcattcgctatgacttcaagtttttctaatatgtatttagcaacatacttatgctttaatttagataatcttgaagaagctattgctgatgtagaaaaaattgctgctgcagcacaaaacttcttagataatcaatattctgcagctaaagaaattgttgatagctataactttaaacgaattgtttacttaggaagtaatgcattaaaaggaatttcgcaagaatctgcattaaagatgttagaattaactgctggtgaaattgtaactatgtttgatactccactaggatttagacatggaccaaaatcaatcgttgatgatgatactttaacagtagtttatattagtgataatgcatattctcgtcaatatgaaatcgatttaatcaaagaaatgagcggtcaaagaaaaggtaataagatcgttgcagtaatgaatggaaaatgtgatgaaatcaaagaactagttgattatgttgttgaatttgatattgatggtaaacatgataatatattacttggttttgattacattgttttagctcaaactgtagctgtattgaaatcattatctatgggtaaaacaccagataacccttgtccaactggagaagtaaatcgtgttgttaaaggtgtaatattatatccatacagtaaaggagaatagaaaaaatgttaggattaattgtaactggtcatggaaattttgctagcggattacgctcttcactaaaattaattgctggtgaaaaagaaaatatgtgttttgttgattttgaggaaaaagatagtgttgaagatttagctgtaaaattatcttctgcaatcgactcattatctaatgttgatggaattttatttttatgcgatttaactggtggttcaccatttaaaacatctgtagaactttctgtaaaaagtgataaacaaatggaagttattggcggtgcaaatcttccaatggtaatagaattatctatggctaaagaatttgttgattcacttgatgcattaactaatatggctctttctacaggtaaagatagtatcgttcgttttactttctctgcccataaagaagaaacaaatgatgaggatggaatttaaagaatgaattgggaagttattttatggacttgcataacggttggtgttttacttgctgtttgcggaatagtaattatgataatttctgctactaatatgaaaaaacgtcgtaaggaaattggcgaagttcatactacattaagagttggaaataagattctttttgcaggaggcttatatggtcgagttgtaaaaatttcaaatgatgaaactattgatgtagaaattagtaaaggggttattgtaaaagcttctcgatatagtatccaaagtattgaaaataaataaacgtatttacaggtttgaaacttggaactattttgatagtataaatttataaaaataatatgaaatgacctcctagattatcaaaatgtggatttagattcagagttttatttaaaagtaaaaattaagaattgttaccatatgataataggaggtcattgtaatttattttgaaatggatacttataaaaatatatttagtttatatgtttataataaattttctagacaaatatgctaaatatgttttaaagtccattgtaaataaaaaacaaatatttaagatacgtactatatattaattaatgaaattggtataaagtatggtgttcttgtagtacgaagatacagcagctgcacaaaaataggtaggacaagaatgatgattttgatatttgtatgattgttaccgaccaagtaaataaaacatataaatttatatatattcttaataattttttggtcattaaaaagtatgtttatatactgaaagatacaaagattatatgagagataattgaatagtaaattattgtgtttgcatttaaaaatttcaaaaaattaaaatgaatcactgcgatggcttaaagagttataactagcattattatttaaagaaacaatgatggttcaggatgattctttttatggtaaaattaatatttacatagatagatcgtgaattatcataaaacgaattttataaagagcaggtttctaaactgcgtggcgctatatgaattgacatagcagttgtaagaaaactaacgtgttttgtattaaagaatgtaaatttaaaaaatatcagtaaaatattaaaaagaaaggatagggatgacttaaaaaagtataagcagcaatgttatagtattgaaaggtagacaaagttttatagatgcttttatatattaataattaatgtgaattgagatttatgcttgataaaaggtcattctataacaggagagaaaagatgaaaaggcttttgagtggtgcagtagcagtggcgcttacactatcttgttttcctttagcaaacaataaaatcgaggctttatcaagtaaggttgatataacgactactgataatcaggttattattggaaacgagtatattgaaagacaattttcaattgctgataacaagctagagacaacaagtatagtaaacaaacgaacagaaaacgaaaatacaatttttacacctgctaatggtagtgaagaatttgttattaaaacagttaaagaagaaagagaaccaatttctttagaagcgattgatcgtagtaattggtctgcgatttcagatagttatcaaaatgcttctggagcaagtgatggaccagcatctaatttaattgatggtaatcttaactcaatttggcatagtaattatggagggggaacaggtagcaggactttcccttataatgtgttatttaatttacatgagcaaacaactttccaatcattttcctatacacctaggcaaaatggtgaggcaacgaatggaaatcttaaaggttatgaactttgggtttacaatggatctaatactgaagatctagcttatgattctgatcaatggcaaaaggttgctcaaggaaattttacttacgatggggtaaatccaatttatgttaatttggctcaagaaactacagctacacaagttaaattggtagcgctttctgcaaacaatggagcgtcttttgcaggtggagctgaatttaatcttcataaagataaagctccagaaatagtggatgatcgttcttttgaaactagtgatttaacattgaaagatgatggtataaaagttgaggatactactgcaattattaatgaagttgaaaaagtaggtaaaaaagtaactttttcatttgaaccatatgaatttaaaaatgttgaatatacaattaatgaagtaattgttatgtatgaaggtgatcacttcatgcgtaaatatatggaaattagcgttcctgaaaatcaagcagaaaatgcggtgattgattatattgatttggaatcctttaatataaatgaaagtgatgttagctggacaattccaacaggtaaaggtggagttgtttcgatggatgaatttaaagctaatttaggacaaccaatttatattcagggaatgtttatgggatgtgaatttccagtagctgatacacagattgtagataataatggatatatgcggtattattcaggaaaatcttttaacagattagttgaagataatcaagcagctaatgttgatggtaaagttaattatatgacatggcaaactgtcgctggtgctgcaagaagtactgaaaacgctgtaattcaaagtgatttctttgaatatattaaatctattgcaacaccttcagaatttagaattcagtataattcatggtttgataatatgatgttaattgatgatgaaaatattcttaactcatttattgaaatagatcgtgaattgaatgccacaggtactagaccattggattcgtatgttgttgatgatggatggaataactataatgatacaagagtagttgatgcagcacgttcaggaacgacattaaattctactggtttttgggaatttaatagtaaatttcctaatggtttaactacatcaagcgaattagttaataactttggaagtaattttggagtttggattggaccacgtggtggatacaatttctacggcagcttagctgatatcttaactaagaatggaacaggtagtaaagctgggggatcaattgatgttgctgatagagtatatgtagaaaactttaaagaaatggcaattaattggcaaaaagaatataaagtaaactattggaaatgggatggttttgcagatacagctcaatataatgcttttccagctagtgatggagtgcctggatatgcaaataatcatatgacaggtggatataaaaatatgtaccatgtgactgatttgtgggaagcatggattgatttaatggaagctgttcgtcaaagtgaaaaggatgataatattaataatttatggatctctttaacttgttatgtaaatcctagtccttggtatttacaatgggctaacagtgtatggattcaatgtacacatgaccgtggagacactggacctattaataataaaatggatacaatgctaacatatcgtgaagctgtatattatgattttattaaatcacatgaattccaatttcctcttgctaacctttacaaccatgatcctgtatatggtgtagagggtacaggtattaatattaattctatgacagatgaacaatttaaaaattatttatacatgatgtcaactagaggaacaggattctgggaattgtattattcagattcaattatgactaaaggtaaatatgaagttaatgctgaatttttagcttgggctgaagaaaatttccacattttacaaaatgcaaagatgattggtggaaatccagctaacggtgttaagttaggtggtatcggttcttcaacaaattatgatacttatggtttttcagcttgggatggtgaagatggaattatttcaatgaggaacccagatacaacagctaagacaataacatttactttagatcgaaatatcggtttatcagaatctattcaaggaaaaacattatataatacattaactcatagttatagtatgcctgaagatggaaacgatgcatatcaaacatttaattatggtgatgaagtaactgttactttacaaccaggtgaaacaagaatttggtctttatcaacaactttagatataactgcaccaaattttgctaaacttgcaactgatggtgataaaacacttatagttaaatttgatgaaaaggtagttggaaatagtttttctgttgaagttaatggtaaagaagctgaaattgaacaagttaataagagtgttgatcaagtaacttatgaaattgttttagcaaataaaccattaaatggtatggaaattgttgtaaaaacaaatgacattactgatttaagtggaaatgcagttaaggatactgataaaacggttgtatatcataaaaagaatgcagttttaacagttcagtctgaaacgttatcaggtcaaaaaacagttggaacagcagctaagtcattaagtgatgataatggttttagtgttcttgtcgatgttaaaacaacaaatactgataaagttcttgctaaacaaacaaatggttatgaagtaggaattgatgaagatggaaaagcttattttgctttaaatggtgtaacagctaaatcaaaagtagcagttaatgatgatgaaaatcataccattcaagcagtcaaagaaaataatggtattttaaaattatatgtagatggaaatttacaaagttctgcatataagttagaaaataaaacttatgtaattaatgctggtaaaacagtaattggtagtgatggttttgaaggaataattggattgaaagtattagatactgcattaggatataatgaatttgcaactaatgaagaaagtggattgattccacaagacagaattactgcaactgcaacatcatatgatagtggtgaaagtgcaacacctgatcgagctaatgatggtaatactaatacgtattgggcaagttctgctactgaaaacaacacagtaactcctcaatatttgacatatgatttaaataatacttatagtataagtaaatttcaatatataccaagatatgattcaaatgtaattttaaattgtacaggaaatattttagaatatgtaatagaagtaagtaatgatggtcaaacttggaaccaggttgcaactggaacaacagttagaactgatcgaggtataactgatattgatttagataaaactgttgaagctagatatgtacgtttgggtgcaactgcaacttatcattggcaggcatctaatgtaaataaaattcttgctgccgcagagtttaaagtatatggtcaagagaaaattgatacagcttctttaaaaacaagaattgaagaattagaagctgtagatacattaaattcaactacatcaagtgtagaaatttttgaagatttattagttgaagctaatgaggtgttaaataatccaacttctcaagaagaagtagatgatatggtattatcattagtaaatgctgaaaatatattagttaaacgtggtgatactgatagtttagtagcattggttagtgaatatgataatttaaaagaaagtgattatacagttgaatcatgggctgtatatacatctgctttaaatgcagctaaagctattattgtagataatagtaatagttctcaaaacgatgttgatcaagtaaaacagatgttaatagatgctaaaaacgctttagtagcagatgaagtattagatacaaataagacagcattacaaatagctgtggaaatggcaagtaatgtaactgaagaacagttggataaagtagtaccagcagtagttacagaatttaaggcagcattacaagaagctcaagatatcttagctaatgataaggcaacacaaaaagaagtagatgcatcatttgcaaggttagcagcagctatgcatatgttacagttctataaaggtgataaagctgaattagaagcattaattaattcaacaaacgaattagtagaaggaaactatacacctgaatcatggcagacattagtggatgcattggagacagcaaatacagtaatgaataatgtaaatgcaatgcaggaagaagtagatgaagcatatgataaattgcagacagcaatagatggtttagaagaagtagaagtagtcgataaatcattattggaagcaacgataaataaagtcttaggattaaatgaaaatgaatatattgaatctacatggaatgcaatgatgccagtattagaagcaggacaagaagtctttggaaatgaagaagcaactcaggtagaagtagacaatgcatatgaagcattgataagagcatacttagacttaagattaaaaccaaataaagacttactaaatgatttaatcaaacaggccaatggattaaacaaagcaagctatagtgcaaaaacatgggatgcagtagaaaaagcattagagaaagctgctacagtattaaatgatccagaagcaagccaagtagaagtagataaagcaaaagcagctttaacaaaagccatggcaggattagtagaaaatccaacagcagataacaatgtaaatactgtaaaaccaggagatacaacagcaggtgtaaaaactggtgataatggtttaataggaatctttataagtttatcaatgttaagtgtggcagggctaagtatatttagaaaaaaagaagattgttaatgattaaacggttatgaatattatccataaccgttttctttttattgagatgacatgtatttaaaaggtctatccatgatgatattaatgtcttaagttctttattgtaaggtgaaatctaaaaaatataaattgaatggaacgatataatatacaagaatacaatattaagattaaatgatagatagtaaatattatataaaatgatgtgagagttaaataggtataatattttatggattatttatgaaaatcactgatgttgtttacttctattgaattatatgtgaatatataattgaaacaaaaatatcttataaaaataaggtgcaaatattttttagtgattaatatttagaaaggagatagggatgaaaaaaaatttttttaaattgatattatgtttgatgatgataatgtcctctgttgtgccattttcatcaaaaatattagcaaatgaagattttataattgttgatgattctgtaacttctaatacagaagaaaattattttacttattctgctagcttggatatagatggggttactggctggtcgaatagtgatgctaattatggtacaggagaattaaagacccaacattgggtttggaatacagataatacagaagctagtaaacatagttacagtttaacttttataggtacaggtgtagaattagttggaattacacctacaggttctgacaaaaatacatttcagttagatgatgaaactgcacaaactgtaacaattgaaacaacaggaaaaaaggaatcaatactatattcaagaaatgatctaatatatggtgaacatactattacagttactttaccaaatgatggaaatcaaaaaggattgcaaattagttatgcaaaggtttttggttcaaaattaggtgaaatagaaagaactactatacctcatactaaaacaactggaacaacaaataaatttactttttctgatacaggctggttttctggaggaaatagtgagcatatttggtcagatgctccatctgtaaataatcccgaagaaatctggtatgaggttgatttcattgggcacaaaattgatatatatgcaggtaaaaatcatcctatgggaatggttaaatattatcttgatggtgtcgaaatgggagaatacagcttatataattcaagtaatattaattctacttttataacttcatttgatggattagatgaaggatttcatacttttaaagcggttgcgacaggtaaaagagatgcaaattcaactaatacattaattgattgctcaaaggttgttgtatatcatgctccatatgttgttgaagatattacattagaatcttcttcatatgtattgatggagggggcgaaacaacaaattaattatattgttttacctgattatgcagttgtaaatgaagtagaatatacttcaagcgatgttgaagtcgctagtgttgatgataaaggggttattactgcagaaggtaaaggaacagcagtaattacagcttatttacctaaatttaatattactaaaacaataagtgttgttgtaactgaagcaactgctaatatgggtggtagtattgttgatattgatacccaatatacgcaagatcgatataatgaagttaaagaaatgggtactatttctaaagaattaacagcatggaaaaacgataaagcaatttcagaaattgccttaatatctaaagattgcaaattaaaaaatgttactcttactgcagaaaatcttgtagatggtaataatgttattgataaagaaaatataaagaccacttttattaagtctgctaaggcttataatggtgcgtatttaggttatggtgatccaaatcgtgaaattccagctgataatggtgtaaaccgttcagaaagttctgatattttatatcaaacaagtcctattaatattgagtttaataaagttcaaccagtttgggtagaaattgtcatccctagtgatgcaaaagcaggaagttatcaaacaaccataacagtagatgctgatggtttagatacaccattggaattcacatatgtcgtaaatgttcaagatgaaatattaaatgatgtttcaacatataaaaatacttttgatattgagttatggcaatatccatatagttcagcagaatattataatgttgaaccattttcaaaagaacatttaaacatcatgcgttctggaatggaaatttataaaagcttaggaggacatgcaatcactactacaattagtgaagaagcgtggtctggtcaaacatatagtgcaaatgatgttcattatccttcaatgatcaaatggacaaaagaggcaaatggaagttttacatatgattttactgactttgataaatgggtacaatttaataaagatttgggcattggtgataaaattgtgctatatagtattgcaccatggcatagctcatttacatattgggaaaatgatcagcttgtatatgaaagatatacagtaggtagtgctcgttataatcaagtttggacagattttttaagaaaactaattgatcatttaatggaaaaaggctggtttgacgaagcatatataggaattgatgaaagaggatttagcagtactgcttttgatttaattgactcagttagaaatattcatgatcaatcattaaaaacagcaggggcaatggatggatttgtaaataaacatgatttagcgttaagagttactgatttgaatgttggtgatacagctgcagatgcacatccagtagaattttcacaattagttaaagatcgtgaagcgttgggatataaaacaactttatattcatgtacagaacatcaacctggaaacttttctttaagtgctccagtagaaagttactggtcaattattaatgcgggtcaagaaacagctggtttcttacgctgggcatatgatgcctgggtagctgatccattaaatgacactactcataattcttttgaacctggggattgttttttgatttatccggatttaaaagatgctaaaaatccaatttctaagagttcagttcgtttggaaagaatgggtcaaggaatgcgggatgttaataaaattaaacagatggtagctaggattcctggattacaaaatgatgttgatgctatgtatgcaaaattgacattaacagctaataccagtagacaatatttaagtaaagcaaatgttacaaaattagcacaagaaatgaacacatttaaaaatgatcttgatgctttaacagaaaaatatttaattttaaaagaaaatgggacagatgaggtatcatcggtagatattttggaaaatgatttacaacttgctcttggaaattcaaaacaattacatgcaactgtaaatccatcaaatgtacttaatacaaaaattgattggcatagttcaaattcaaatattatcagtgtatcagatagtggattaattagtgcaaatggtatgggtagtgccgttattacagcaatatcaaatcaagatccaactaaaaaagacagtattacagttacagttactgcacctcaaattgaagaaagtgctcgagtggcttattattcatttgataataatgatgcgacagataattggggtagtagaaatggtatagtgaatggggctggttttgctgaaggcaaatctggtaatgctttgtatattgaagaagaaaatagaaatgtaacatttaatagtgattctggaattggagaaaatgattcttggtcgataagttattgggtaaaatctactgcccctattactgatcgtatttcaattttaatggacgcaaataaagattattcatttgatttgaaattagctagtaatcgcagtgcaggttatcatgttggtaaaaatagtggtgatgtattaacttttacatataattttaatcaaaatgaatggtataatgtcacatggactcagagtaaaagtacaggtttatcaatgtatgtaaatggtaatttagtaaatactaatgcttggactaaaacaaataaagcgttactgccattagatattattggtggtactggatttactggatatattgatgagattaaagtatataatcgagtattgaatgctagtgaagttaatgccaatatgttattaaacggtttaaatttaacagaaaccagcaggacaatgtttattaatgatacttatcaaattgaaactaatttaattagtgataatgatgataagactattacatatacatcaagtgatccgcaaattgtctctgtagatgaacagggagtagttactgcattaaaaaggggaacagcaaagattattgtagaaaataaagctggtggatatagagaagaagtactgatcacagtaaacaaaaatatttcaataacaagtaagataccaatgtatcaactatctgaaaataacttatctgatattgaaaaggcccctaatactgatagacaatatttagggcagccagatatggtgcgtactaaaacaggtagattaattacagcatatccaaaaggacatggaaaaggaccgttgattatgcaaattagtgatgataatggtgaaacgtggacagaaaaaacggatacaccatcatcatggacaggttctcaggaaacaccaactatgtatattttggatttagctgatggtacggaaagaattttattaattacggcgtgtccaggctggggcacagatagtgctggtaaccagtatggatggaatacaagttattctgatgataatggtgaaacatggaatgaatataatcattggtattcaagaagaagttatgataacgctaataatgatgcaatagttgccatggcaagtttagtacagctaaaagataaagatggaaattatattcaaaaatggatgggggtttatcataactatggttatgtaaactttaaaacatatttaacatttgatgaaaatggtaatgagcaatggacggacccggttccttatttaaatgagtatcgttcaattgaatcaacttatcaaatgtgtgaaatcggaatgtttagatcaccagatggaaaacaaatcattggacttgcaagaagtcaatctcataataatccagctacattaatttattctgatgatgaaggtgaaacatggagtaaaccaatggatttaccaggatctttagctggtgagcgtcataaagctgtatatgatccagttagtggacgtttagtaattacttttagagaaattaaatatgatttaaatggcaataatcagtttgatgggtatagtgactggacatgtggtgaatggattgcctgggtaggaacttatgaagatttaatggagcaaaacgatggtgaatatcgcattttattggctgaagattggtcaaataatgctaaatcgggtgatacaggttatgcaggggtagtagttttagaagatggaacatttatcatggattcctatggtcattgggataaagatttttcattgagctggcctaatggagttactactgatttgtgttatattaaacaggctaaatttaaattaggtgaaattgaaaatgctaataatttaataaatcgtgaagctttaaatgattttattgtagaagtagaaaatactgatagtagtctttatacgaaagaaagctttgctaagtttaaagtagccttagacaaagcaatctcagttaattgtgataatgtttctcaacagattcaaataaatgcagctttagaatcattaattgcagcttataatgatttaaaatttattgatcaaacaatagataaaacagcattacaaatagctgtagatacagctaatatcttaaaagctcaaggggcattggataatgttgtacctgctgtagtaacagaatttgaaactgcacttgctaatgcagaagcagttttagctgatactagtgcaaatcaagctacgattgacagtgctttctatcgtttagctaacgcgattcatatgttggaatttgtaaaaggtgataagagtgctttagaagccttgatcaatgaagccaaaaaatatgaaaaaggaaattatacaactgattcatggacagcatttaaagaagccttagatgcagctagagatgtcatgagtgataaaaatgctttagaaagtgatgttaacaaagcgttaaataatttaacagaagcaatctcaaacttagtcttaagagctgataaaacaagattacaagaagtatatgacaaagtaaatggcttagataagagtctatatacagaaggaagtgttgctaacttagtagaaccaatggcaaatgctaaagcggtattagatgatgcagatgcaacacaagaagcagtagatgccgcatatgaagcattgataagagcatacttagacttgagattaattccaaataaggatctattacaaggattgatcaataaagctgagacattaaatgccacaaattacagtgctaagacatggtcagtaatgatggaagcgctaaatgaagcaaaagcaacattagctgatccagaagcaacacaggaagaagtagatactgctaaagaagtattagttaaagcaatggctggattagaagcaagtaattcagtaaaagctggtgatacaacagcaagtgtagctactggagatacgacaaatatgttatatccacttgcaggattagcatttgcaacattagcattctatgaaagtagaaaaagaagatataagtaaagataataaaacaaggcttacagatgtaagccttgtttagtgtctttaaaagtattttttatagctgtatataaatttatttatatatttttttagcatattcacttggtgtaagattaaaatgctgcttaaatgttctagaaaaataatgaattgagctaaaaccaagcataaatgctatttcactaattgtgtatttattttcacggataagttctttacttttttgcaattttatttggaccatataatttttaggggaaacttctaaattacttctaaatagagtttgtaaagatgaacgtgaaatagaaaacttatgacagatttcttcaatggttaaaggttcagtaatcatttcgttcatgtaatctaaaatctcatgtaataattcatcttgaaaatgttgcattgatcccgttgatacatgtttttgatctatcgataaatcatattgggtcaataaaataatgatttcttgtaaataacaaagcataagtgttttagaatatggtaatgaatttgaactagctttgacaaatttattaaatatgttatggagttcattatcacaatgaaatatacgattgagaattagatcatcttcgatgatttccatatcaaaaataacagttaaataagaacaagatttgttagttgtgatttgttgagtatgaaattgttctggtccatatagcattaaatcataattatttaatgtatatgttgttccttcaactgttgtatcgagactaccatgatctacatatgttaattcgtaatgtttatgggcctcgcctttaaaacgataattgggacttttaattacataataataaccaagaatttcttcaatttttaatttagatacaattggtttataaacatatggaggatttaaaaattcagtttttaaattgtagtttgaaggagtaattaagtaactttcaatttcttgtgataaagggataatattgaaataattatttgcttcaatttttaaataacgatgaatagcaaatgtttctaatttatctggatctaaactatcaccaattaaaatagaagcgattccttcagtaagttctatatatactgcacatgaaaaacagtacatatggctaataacccttcctgatgtatttaattttctacatattaagttgtctgtaactgataaatgatcttcgtaagtagagccatattttttaaattcaatacttgatgttttattaatcatagaaaacctccttgtataattagctaatctaattacacatgactaaaatatacatatataatatactttttattacaatttttgcaaatattattattaataaattataattattttccgttaggtagaaatgggattaagttaattgctactgcactaataggcatagtttgtaaaataatcttaccgggaccagtgattacggtgttaaaaaaaccttcaccacctagtaatttatttttgataccttttatactttggatttccatggtacatgttgcttccatcattgccaagtaacctgtgtcaatgatcatctgttgaccaggtaataggtcgtattcaattgctgagccatcaatttctaaaaaaactgtgccggttcctttaatttttgtcataatgaacccttcaccaccaattaaaccggaagaaatttttttattaaggaatacagatacttcaatattctcacttccagctaaaaatgctgatttttgtacaatgatttcatggccgggatttacttcaatggcttttatactgcctggaaaagatgaagcaaaagctatcattccatcttcagtagcctgatattgattttgaaaaatagtctcaccgctaaacattctgccaaaagcttttgatagtccgccacttgttgtttccattttcattacaggatccatccagctcattgcgccactatcactgagcatatattcacctttttttagatggcaaatgacaacaggaagatttcctcctttgatttcataattcatattgtacctccttgtacatataagtttttatttaattgcaatacatataggtgctggaatagtaagggtacttgctgttcgtattaattcttctttttcttcattaaatgttaataattcgatttcattatcatcttgtgcgcccacgattagatatttatcattaataatattaaaatctcgaggattttttcctgtatgaaccatgtataatagtgttaatttaccggtttcttgattaattcgatataaaacaatactatcatggccacgatttgaaacaaataaatgtttaccagagctgctcaaacgaattgcactagcactagaaaagccatgaaaatgatgaggtgtagtatggattacttgaattaatgtaaaatacttatcacgatatttaaaaaccattacgttattagaaatttcattgacaagatatgcaaattgtccatcatgagaaaaaatcatatgtcgaggaccagaaccaggaacaatatttaagttataatttgaggcttcttctaatttaccgttttgataagtatacataattattttatcagcccctaaatcaactgcgtaaacaaattctttatctggtgtaattcctacataatgacaatggggtcctgtttgtcttttaagtaaatcaggacctaaaccagtatgatgaacagcactgattttttctttgatataataattttctaataaatatgaagcggtagctccgacgtggtaattagctgcaaaaagatagcgtgaattatcgctaatacataaatgggtataagaacgaccgttagagttataattgttattaatgatcaattcatctttataaatagaaaaactacccagtccaccgccggtatttgaacgactagcatttttataggcgatatataaaatattatttttaatgatcatatataatggataatctttggttatgatatgttgtacaagtgaaaattcttctgtattttcattaaaattaacgatatatattcctttattatcattttttccataacttgatacataaaatgtttgcatatttgaacctcctatatcttattttagcacaaatattaaataaagtgagcgatatcattggatttttaaattattctatatctgcttaatctttaccttatacataaaatgttatataataaataaaataaattggaggatagaaaaatggatgaaaacttattattgacattacttcataataatgcgcgaatggaagtgacagatttagccatggcattaaatgaaagtgaggataatgttgttaaagcgatcgatcagttgcaaaaggataaagttatttgtggttatcacacaattattaattgggatcgtactaataaagataacgttatggcattgattcaaatcaatgctacacctgaaagagagtatggttatgatcgtattgctaaaaagatttatgcttttcctgaagtagatacgatgtatttattaagtggaagttttgagtttgttgcgattgttaaaggacatactatgcaagaagcagcccgttttgttgcctctaaattagcaccgttagatggtgtaactggtactgcaacaatgtttgtattaaagcaatataaaaataatggtattagttttgatgacgacgataaagaaactgcagaaagattattggtaacaccataatggattttaataaagtattaaatgatacagtaaaaaaaattccaccaagtggaattcgtaaattctttgatttagctaatgaaatggaaggggttatttcattaggggtaggagaaccagattttgatacaccttggaaaatcagagaagctgcaatttattcaattgaacaggggaagactttttatacagctaaccaaggtttagttgaattaagaaaagaaatttgtcgttatcaaaaaagaagatttaatttagactatcattatgctaaagaatgtgttgttactgttgggggatcagaagctattgatctagcttttagagcattgatcaatcccggtgatgaagtaattttattacaaccgagttatgttgcttatacgcctggggtagccttagctggtggaaaggtcgttaatattgaacttaaagaagacaatgagtttaaattaacacctgaacttttagaagctgcaataacaccaaaaacaaaagcaatcttattaaattatccaagtaatccaacgggtggttttatgactagagaggattatgctaagttggtaccaattattaaaaaacatgaaataattgttataactgatgaaatttatgctgaattatcttatgaacaaaaattctgttcaattgcttcatttgatgaaatcaaagatcaagttattttagtcagtggttattcaaaggcatatgctatgacaggatggcgcttaggatatgttttagctaatgaagttttaacaaaagcaatgaacaaaattcatcaatatgtaattatgtcagcacctaccggagcacaatatggagctattgaagcaatgcgtcattgtgataacgaaatcgaagcgatgcgccaggcttatatgttaagacgtaattatattgttaaagcattcaatgacatgggattgcatacatttacaccccaaggagctttttatgtatttccttgtattaaatctacaggaatgacttcagagcaattttgcgaagagctgttaaaagatcagttagtggcatgtgtacctggaaatgcttttggtgaagctggagaagggtttattagagtgtcttatgcttattctattgaacaaatcaaagaggcaacttcaagaatcaagaagtttttagataaattaaataaataggaattaacatttttgttaattctttttgtttataaaataaaagattacatacttagaagtttacagtataaattatagctaacaatattgttaagtgtttgtaaagttaatattatcctagaaagatttatactataatatgtaaaaatttggaggtatgtaataatggaaaattatcagataggtcttagcagcaaacaagttcaagaaagaattgatgagggattggttaatggcactagcaaatctgcttctaaaacatactatcaaatatttaaagaaaatatttggacattatttaatttacttaattttttaatttttattgctttagtaatggttaaagcttggtctaatactatttttatggcaattatcgtatgtaatgcaataattggtattattcaggagattaaagctaaaaagcaggtcgatcaattatcaatacttactaaaccactaataacagtaattcgcgacagtaaagtacaaactattgatattagtaaagttgtaatggacgacattctagttttagaaagtggaaaccaagtatgcaatgatgcaatcgttgttgaagggatgattgaagctaatgagtcacttcttaccggagaagttgatccaataaataaaacagctggatcaaaattgttatcaggtagtagtgtagtatctggtaaatgttatgcccaagttattagtaccggagataataactatgctacagcacttgttaaagaggctcaaaaagtcaaagaaactaattcagaattaatagattcaatgaaaaagattactaagcttaccacttttatgatcataccattaggaattattttatttatagaagcattatatttaagacaagatactttatttaatgccgttgttttttcagcggctggattattagggatgttgcctaaaggtttggtattacttacaagtgtatcattagctaatggaataacaaggttagcgaagaaagatgttttgattcaagatctatattctttagaaactttggcacatgttgatgtcttatgtttggataaaactggtacgataacgaatggaaagatgaaagtagaacaagtatttaaacttgattcactgaaaaattgtcaaattgaaaaattaatgggttcttatttaaatgcgagtgatgataataatgctacttttcaagctttagatgattattttaatagaaataatatgtatgaaagtataaataaaatatctttttcttcattgagaaaatggagcgctgtagagtttaaagaaattgggacagttgttgttggagcggtagaaaagataattcaagatgaattgccagaagaaataaaaacttttatggatcaaggaatgcgggttattggagtaggacatacatcaaaggaaattaatgaaacaaaactacctaaattaaagccattaatgataatcgttttatcagatacaattagagatcaaactaaagaaactttagaatattttcatcatgaaggaattaatataaaagtaatttctggggataaccttaagacagttacagcaatcgctaaaaaggctggagttttagattttcaacaaggaatcgatatgactaaagttactgatgatgaaatagaaaatattgttcaatattatactgtttttggtcgtgttacacctaatcaaaagaaattgatcgtcaaggctttaaaagaatcagggcatcaggttgctatgacaggagatggtgtaaatgatttgttagcattaaaggaagcagattgttcgattgctattgctaatgggagtgatgcttctaaacaaatttctcaggttgtattattaaaatctgattttacttgtttacctgatgttttattggaaggaagaaaagttgtaaataatgttacgagagtggcaggtgtttttttcattaaaactatttatacgattttattgtctttgctttgtgtgatttgtaataaagagtttccgtttattcctttacaaattactttaattgatcttttgattgaagcaatgccttcatttatgacgatttttgaatcagatattagaaaaataaggggatgttttttacctaaggtattaagtaaggcttttagtagtgcaataagcattattattatttttattttaattatgttgttaacaccgatttttaaattaaatgatttagaatctgtaacattaatgtatttggttttaggaattatttcaatggcagcagtaattcgttcctgctttccttttacaaagttaagactcttaatttgtattattatgataggcggttttagtagtgcggtattattattttatgaaactttaaatcttgctaaaatgagtatcagcttatttttaatggtctttggctgggtagtgattggcttgcttatagaaagaaaaattcattttatgattagaaaaaatagggaatttttataaattttttaactttttgattataacaccgaaatttcggtgttataataggggtaactcgaatcacgaatttttgaaatttattataatataagtgataaaaggagtggttgattatgaaaataaaaagttatgaaaaagttatcgataaagatatcatcgcagttaaaagttatttattaaaaattggagaaagttattggaaacaggatcttgatgatgttattaacagcagtattgatatgagaattattagaaacaaaattaataagagaaaagatttacagttattgatttttagtaaaataaaaagattgattgatgatagtgttgattttgatgaaatggaggatcatttaatatttatgaatattttattaaatgcgcactatcaacctttgttgacatataaatataatttattaaattatattatcgataaaggtggtttttcagtagaaacatattgtctaattagacatttagtaaattttaatgaaaaaataatagaatcattgattgatgctttagctaatcgtctaaacttagattttgagcgttatcattatttagccagttatattttgttattagaaaaggaatataaaaaagcatatttgcatttagaatatattactattgatcatagctttgagcgctttttaccagcgttatataattttagtcctcgtctatatttaagatattctaaaaagaaacatatgcctttgaatcttgtaacaggataggaggatcttatgggtgaaaaaatgtattacatttataaaactattaacgaaagcaaaggaataattagtgcaaaagaaattcaggagtgtttaaaacagtatgaattgttccttaatgtaaaaactatatatagcttgattgatcgaatcaatgatttttatatgtgtctaactaataagcagttaataaaagctattaaaagtaagggatatattattgaagatgcattttttgatgatggtcaattacaaatattaatagatagtatcatttttaaccctaatttagatcaaaaatcagctaaagagatggttgataagttattgttattaagttcatctaatcaaattaaaagaataaatattgaagacaagcatagtaatgtattagattatgatcttttattaacccttacaacaattattaaagctattaacatgcgaaaaaatattgcatttaaatatataagttatgatgttatagatgatgagctttcagaggtttatcatactaatggtaatcaaagctttgatacgtatgtagtttcaccttatagattaattttgaaaggatctaattattatttgattggatattttaataaaagagaaaatagtttaagtgtttatcgtgttgatcgaatccgtttagtcagaaatcataatagtaattatatagatatccaagaacagtttgatatgttaaaagagattgataaaaatgttaatatgtatcttagtaaaaatcgaatagatttaaaaataagatttaatcaggggattttaaaagaagttgttaatcaatttggaaaagaaatacttgtgagtaaaagatatgatggaaaaatagaagcaatcataaaaaatgttgcattatcagatggtctgattggctggctgatgatgttacagacgaatgtccaagtattattgccactagatttaaaagaaattatcaaaaagagattaaatttaatgttaagaatgtatgaacaagattctgagtaaggatcttgtttttctttacataaacttaacataataaatacaatttattgatatatcatcagatacaattctcttattatataggtgtcttaagatagtaagaagaaagggattaaaagaatatgaaaaaagtattaggaattttattaacattagtattatgcttaggtttaactgcctgtggtggatcagatgatgcaggtgaaggaagtaatgaagtaagtggaaatgtaagtttgaatggttctacttcaatggaaaaatttgttaatgcattaaaagaagcaatcgtagaagattacccaaacttaacattagaaccacaatttactggttcaggtgctggaattgaagcggttttagcaggaactgctgatatcggagattcatcaagagctttaagcgatgaagaaaaggctaaaggattagaagaaaatattgttgcaattgatggtattgcagttattacgcatccaagcaataaagttgataatgtaactacagatcaattgaaaaagatttatacaggtgaaattactaattggtcacaattaggtggtgatgatcaagcaatagttgtgatggggcgtgaagcaggttctggaactcgtggggcatttgaagaaattttaggaattgaagatgcatgtaaatatgctcaagaattaaatgaaactggtgctgttgttgctaaagtaggtgaaactaaaggggctattggttatgtttctttagataatattactgatagtgttaaagctttaaaattagatgatgtcgaagctagtgaagaaacagttaaggatggaagctatactttacaaagaccattcgtaatggcaactaaaggtaaaattagtgaacaaagtgaaaaagtgcaagcagtgttcaaatttattgaaagcgaaaaaggacaagaagttcttaaggccgtaggtttagtaagtccaaaataggagtttgttatgaaaaaagatatgttatctattattagtaatagaaaaacaaaatctttggtggaaaaaacagccgcgattatatttcgtggctgtgctattatgtctatcattgcagtagtttctattacaggatatatgattatttctggtacgccagcaatatttaaagaaggattgacaggaatcttgtttggtagcgtatgggcaccaacggctgctgatccgcaatatggaattcttttaattatacttacatcaattgttggtgtctttttagcaatttgtatcggggtcccaattggattgtttactgctattaatctagcagaattagcaaatccaaaagttagaaaaattgttaaatctgcaattgaactgcttgcagggatcccatcagtagtttatggcttgttaggaatcttattgatttgtccgtttatgtataaattagaattaatgatttttgcaggttcaaaaacacatcagtttactggtggagctaatttaatttcagcaattttggttttaacgatcatgattttaccaactttgatcaatattacggaaacagcattaaataccgtacctgatgattatcgtaaaagttcattagcacttggagcaagtcaaattcaaacgatttttaaagtagtgttgcctagtgctaaatcaggaatcatgtcagctattgttttaggggtaggtcgggctattggtgaagcaatggcaattttactagttgcgggaaactcggtgaatgtgcctttaccatttaattcagtacgttttttaacaactggaattgtatctgaaatggggtatgcatcaggaactcatcgagaagtactttttacaatcggattagttttatttatctttattatgattattaatttgattttaacatttattattaagaaaggagatcagcatgaataatcttagtatttttgacagaaaaaatcgggttagtgataaagttttaaattttttaattcaattttgtagtgctttgtcagtgctgattttagttgtttgtattggttatatcctatatcgaggtattccacattttaatttctcttacttagttaattctactagtatcttaaaaggtacgattggaattttaccaaatattattaatactttatatattattgttgttacattattatttgcatgtccaattgggataggcggagcaatatatttaaatgagtatgcaaaaaacaagaaatttgtaaatgttatatcttttacaaccgaagtattggcgggaattccttctattatttatgggttgtttgggatgttgttttttggaaatttgttaaaattgaaattttcaattttaacaggttcatttacacttgcaattatgatcttaccaattatttctagaaacactcaagtagctttagaggcagtaccgaagagttatcgtgaagccgcactgggaattggggcaactaaatggtacatgatcaggacagttttattaccaagtgctatgccgggaattttaactggggtaattttaggaatgggtcgtattgttgcagaatcagcagcgttattatttacagcaggatcagtaagtgtgttacctaaaaatatttttactcatttaacaagttctggggctacacttacgattcaattgtacttagagatggcaaaagccaattatgaaactgcttttgtaattgctctcgtattaattgtcattgttttattattaaattttttagcaaaattaatttcgaataaatttgatgtaaataaggtgaaatagaatggaaaataaaattgaagcaaaaaatctggacttatattatggtgaaaaacatgccttaaaaaatgttaatctggatattaagacaaataaaattacagcctttattggtccttcgggatgtgggaaatcaacatttttaaaaacgttgaatcgtatgaatgactatgttaaagggatcaagatcacaggtgatgtaaaattagatggagaagatatttatgatagtcgggttgatacaacgatcttaagaaagaaagtaggaatggtttttcaacagcctaatccttttccgatgagtatatatgataatgttgcttatggaccacgaattcatgggataaaagggaaaaaagaattagataaaatcgtgaaaaaatcattagaggcagcagctttatatgatgaagtaaaagatcgtttacacactagtgctttgggcttatctggaggacagcagcagcgattatgtattgctagagctttagcggtagaaccagaagtaattttattagatgagccaacgagtgctctagatcctatttcgacattaaaaatagaagaattgctgttagaattaaaaaaagattatacgattgcaatcgttactcataatatgcagcaggctagtcgaattgctgactatacagcttttttccttgttggagaaatggttgaatatggtgagactaaagatgtttttgcaatgcctaaagataaacgtacggaagattatattacaggtagatttggataggagaaaaaaatgttaagaagtaattttgaaaaagatttaaataaattacatgttgatttagataaaatgtgtcatttggttgttttggcaattgaaaattgcattacagcctttaaaagtggtgatcgtgaattatgtcgcgatatcttatctggtgataaagttattaatgatatggaaaggacgatcgaagcacgctgcttatctttaattttgaaacagcagccaattgctagtgatttaagaaatgtttcgacagctttaaaggtagttactgatttggaaagaattggtgatcaaagtgctgatattgcagaaatcttattggaaactgatgttaaatgtccttataaaatggttgaacatattcctaatatggcatgtctagcaagagatatggttaaaggatcgattgaagcatttcatgaacatgatttgaaaaaagctgcaaaaattaaggaattagaaagtcaaatggatggactatttgaagatgttaaggtagaattagtgcaaatagtaaatgaagataaagaaaatattgatcttgtcatcaactttttgatgattgcaaaatattttgaaagaatcggcgatcatgcagtaaatatttgtgaatggatcgaatttaatcaaactggaacggttgataattatcgtttaatttaaggaggactagtaatgggcgaacgtatatttgtagttgaggatgatgaaaatatccgtgagataataaatttggctttagtgagcaatggttatgaagttgttcaattcaataatgcaattgatgccttagatatgctttctaaagagacaccttcactggctatttttgatttaatgttgccaaagatgagtggaatagaggcaataaaaaaaattagagaaactaataatgaattaccaatattaattttaagtgctaaagatcgtgaaatagataaagtaaatggtttagatagtggatcggatgattatatgacaaaaccatttggaattcttgaactacaagcacgagttcgttctttacttagacgccatgtcacaagtgatattattaagactaaacatcttattgttgataaacagacgcgaatcgttaaattagatgatcaaaaaatagagttaactaataaagaatatcaattattagtatacttaatggacaataagcatcgagttgtagaacgtgaagagttattaaatgagatttggggttatgattttgttggagaatctagagcgttagatgttcatattcgtgctttacgcagtaaattaaaagatgatggtcataaatatattaggactgttcgcagtgttggatatcgtttttacgaagaaggtgatagtagtgaataaaacgatctttcgctattttttaacaatattacttgtaactttaatattatctaccagcatatcaatggtcatattatcaaatcaaatgttagaaaatacgaaacaggatatgctttatgctgttaaattagttgattatcagttagatgataatcaagatataaaagagcaggtagatgctttaaatcctcttgcatataatgatcatacgcgattaactgttattgatgttgatggaaatgtactcgctgatagtggtgaagatggtattttagaaaaccataaaagtcgtgaagaggtaaaacaagctttgagtgatggggttggctatgctactagatattcaagtacggtggggcgtaatatgttatatgtagctttgtataataatggaagaatcgttcgcttatcgcttccatatgatggaatttttgataatttaccaactttaataaaacctttaggaattggagctggtatttctttgattgttgcgatggtattatcaaagcgtttttctgatacattaacagcaccgattcaagatatcaatacccaaatcacgaaaatgaaagattatcgcgaattggtattcgatgattataagtatgatgaatttaatattattgcttctaaacttgaagaacaggcatcgactattcatgctactatgaaaaaattgaaagatgaacagattaaaattaatggtattttaaatcaaatgaaggaaggctttattttattagatagtgatttaaatgtgctgatggttaatcgtaaagctcaagaattatacaacaataccattaaattaaataattcaatcaaagattttatttttgattttaaaattattgatattttagataatttaggtgaagaacagcaaagagttgaaatagaaaaggaaaagcagttttacaattgttatattgcaaaagttgattatggtgtaacattattatttgttaatattactgaacagcacaatgctttaaaaatgcgtcaggaatttttttcaaacgtttcacatgagttaaaaacaccaatgacatcgattagaggatatagtgaattattagaaacaggtgttattaatgataaagaagcatctaaaagagcattagataaaattcatgatgaagttaataatatgtcaacattgatcaatgatattttaatgatttctcgattagagaataaggatattgatgtaattaaacatccagttcatattgaaccattagtaaatgaaataattgatacaatgcaagttgaaatagataagaagaatctaattgtaaataaagaaatttctgatatagtttatatttcaaatcatcagcatatgtatcagttattaagtaacttaataactaatgcaattaaatataatgtccaaaatggaaggattacgattaaatcttatgatcaagaacgaaatattgtaattgaagtaagtgatactggaagaggaatttctaaaatagatcaagggcgtgtttttgaacgtttctttagatgtgatcaaggacgtgataaagagactggtggtactggtcttggtttagcgatagttaaacatattgttcagtattatcaaggaagtattactcttacaagtaagttaggacaaggaacaacttttaaggttgttttaccgaaaaattcatattaaataatcatggcaatagtcatgattattttttaatatacaaattttttgaaaacaaaataacttgtaattttgcgataaataatggataatttaaatgaaagggattacatagattttggggctttgatactatttttagaatattttaaatatacaaaattataacgagcaaatatttgagtaattcttaaaataaaagggagatgtatatgtaatcatttttcaatgaaaggagatgaaagaaacgatgaaaattatgcataaaatatgcaaaagtttaatggctttagtattgtgtcttacaagtatgttttctttaagtgtcaatgtgtcagctgaagaaattagtaacaaccttgctttgaataaacctgttgttgctagtgctgaatatagtacaatgccagcatcatatttgactgatgccgacgaagatagtcgctggtcagcagaaagagatgcagtacaatgggcatatgttgatttgggacaagaatatgaaatgaataaattccaaatgatttgggaaagtagttcagtctatgctcaagaatacaatatttatgtatcgaatgatataaatgattggggagcagcagttgttgttagaactgaaaataatagtaaaacttctgaagatcttttagctcaagccgttaagggacgttatgttaaacttgaagtgacaaagatgaagggatatcctagtgtttcttgtcgcgacttcaaagtattaaatactgatgaaaagtatcaagatccaacagaaaatgttgctttgcataaaacagcagttgctagttcaatcgaagctaactctgtaagagccgcaaatgctactgatggtgatactacatcaagatcttcaagatggggaagcgatattggtaatggtccagactggatctatgttgatttaggtgaggtattagatgttaatgtcgtaaaaattttctgggaaaatagaaaagcaactagctataaacttcagattgctgaagagttaagtgatccaatgagcgaagatgattggacaacagttaaagacttcaacgatcgtccagcatctattgatgaaaaaatcgaattagatcaagtgtataaagctcgttatgtacgcttattgattgattcacatacatctacagatccagatggaggagttacatggaatacagtttctatttatgaaatggaagtgtatggtggtaatccagatactaaaccaacaattggtgaagtattaaatgctattactgtagatacgcctaatcctggggataagaagttatcaattaatttacctgaaattgaaggatataaagttgagtacaatggtactgattttgaacaggtgattgatgatgatttaacgatttatcaaccagtagttgataaagaagtaaaagtttcatttaaagttacagataatgatactaatgattacaaatttaaagaagtaaaaataactgtacctggtaaatatgaggttgaaaatagtgataataaagcgccaaatattttgccagagttggctgaatggaaaggtgaagcaggaagttttacgatttcaagtaatagccgagttattattgctagcgatgaattacaagatgttgctaatgcattggtagctgattataaagatatgaccggtaaagaattaaaggttgttaaaggaagcaaggcagatgtccaaaatggagatttatattttgctttaacagatgatactagtaaaggtttacaagatgaaggatatttaatgtctgttggtgaatatgttgaagttgaagctgaaacgacaacaggtgcttactgggctactagaactattttacaaagtttaaaacaaacaaatgatattccttgtggtattacaagagattatccgttatataaagttcgtggtttcattttagatgtaggtagaaaaacttttacattagattatttaaaacaagttgttaaacaaatggcatggtataagatgaatgatttccaagtgcatttaaatgataacttgattggactagaaaacgtcgctgatccaatgagtgcttattctgcgtttagattagaatcagatgttaaagcaggtggtaataatggattaaatcaagctgatttaactagtacggatatgttctacacaaaagatgaatttagagatttcattaaagaatctagaacttatggagtggatattgtaccagaaatcgatactccagcgcattcattagcacttactaaagtaagacctgatttacgtcatggaacaaatggtagaaataatgatcatttagcattacgtgataaatatgatgaatgtcttgattttgttcaaagtatttttagtgaatatatgacagatgatgatccagtgttcgatgctcagacaatcgtacatgttggtgctgacgaatataacgctgataaagaagcatatcgtaaattctcagatgatatgttaggatttgttcaagagacaggacgtacagcacgtatttggggaagtttatcacaatgtcgtggaacgactccagtaagaagtgaaggcgtacaaatgaacttatggaactttggttatgccaacatggatgaaatgtatgaacaaggttatgatttgatcaattgtaatgatggaaattattatgttgttcctaatgcaggttattactatgattatttatatgatagcacactttataatttagatatcaatactattagtggagtgactattcctgctggtgataaacaaatgatcggtggggcatttgcagtatggaacgatatgacagattatcttgaaaatggtgttagtgaatatgatgtttatgatcgtatagaaaatgctattccattatttggagctaaattatggggtaaaggaactaaatctttaaatgaagctaatgttgctagagctgcaataggtgatgctcctagaactaattttggatatgatgttgatagtaaagaaggaatcattgcaaattatccgatggattcactagtggataatagtgaaaataatcgtgatttgacagctggaactaatgcttctattgtatcagtggatggaagaaatgctcttaaattaagtggtaatgaaagttatgtaacttcaccagttactacagctggattaggaaatgatttaagagtaaaagttaaacgtacatcaaacagtaatgaagaacaaatcttatttgaaagtagttatggaacaatcaaggctgttcagaaagatactggaaaagttggattctcaagagaaaatcatgattattcatttgattatgaattacctataaatgaatgggtagagcttgaatttaaaaatgaacataacgtagcatcactttatgttaatggtaaattagttgatgttttaggtgatggtgagaagattgaaggaagaccattacttgcgacaacgatgttcccacttgaaagaattggaagtaaaacaaatgcttttgttggatatgtagatgatattagaattggtgaaaataaaacatttaattctacaatgaatcttgattatgctgtaataacagctaatgcactattgcaagaaaaagataacacgatattacaagcgttagttgaacaagctcaagaattatttaaagtatatgatccagatagtacagaaattgaagatttaacagcacaaatcaatgcaatcattgaagcaactgattatacaaaagctgattacagtcgtgtaaataaatatttagatttaatattagatgatttatcagcatttagtgaagaatctgtagctcgtttacaaaacgtaattaatagtatccgtcgcgatcttccagcttcaatgcaagaaacagttgatggttatgcaactcaattagctaatacactagcaaatctagaattaaaagtacagcttaatgtaaattatgttgataattctaaacttacagctacggcatcatcttatcaacgtgatggttctgatccaagtaatgtattagacaataatactggaacaatgtggcatacagactggacaattactacgatgcctcattggcttgctcttgaaattgatgaaccaacagcaatcaatggtttgagttatacacctcgtcaaactggttctaatggtaatgtaactgagtatcgtattgaaattagtgacgatggtgaaagttggaatacaatcaaaaccggaacattaagttctgattctagcactaaagtaattgaatttgatagcgttacaactaagtttattcgtcttgtttatgttaaagctgtaaacaataatggtagtgcatcagaaattaagttacatcgtgctgatgttcctgctgatattgatggattaaatacgttgattgaaaaagcagaaagtattaaaaatgctggatatactgaagaatcatggacagcacttcaaagtcaaattgcagcagctaaagaacttgctaatttacaagctcctgatgcaaatgaagttgaacttgctaaacgtaatttgacagaaaagatggttaaattagttttagatgaagaagaagtaaaagatgtagataaatttgcattatcaatagctgttgaaatggcaaataatgtaactgaagaacagttagctaatgtcgttccagctgtcgttaatgaatttaaagcagcgctacaagaagcaacagtaatcttagctgatgatagtgccagtcaggaaacagtcaatgcttcatttgcccgcttatcagttgcgatgcagatgttgggatttgtaaaaggtgataagagtgctttagaagctttgatcaatgaagctaatagttatgcagaagaaaactatacagttacttcatggacagcatttaaagaagccttagaagcagctaatgcggtagtaaatgatgaaaatgcaatgcaggaagaagtagatgctgcttatgctgatttacagacagcaatcaataacttagaaacagcagctaaggcagataagacattattagaaggattagtaaatcatattctaggactagataaagataagtatgttgaagaatcatggaatgcgatggtaccggtattacaaaaagcacaggatgttttagcagatcaaaaagctagtcaaagcgaagtcgataaagtatatatcgaattagtaacagcattcttgaatttaagattcaaaccagtagaagaggtagataaaactgcgttagaagcattaataaaagaagcagaaggctatgatgaagaagaatatacaccaagtacatggaatgtattagaggaagctttagaagcggctaaagaagtaatggcaaatgaaaatactacagaagctgaagtagaaacagcagtcaatgatttacaagaagcaatcaatgctttaacaaagaaagccgataaaggattcttagaagagttggtcaatagagtagaagaatataatgaagaagattatataacaggatcgtgggcaggattacaggaagctttagaagcagcaaaagaagtagtggcaaatgaagatgctacagaagcagaagtaatggatgcatacaataatttaattgatgcagttgaaaacttgatttttagagcggataaatcatggttacaaaaattgtatgatgcaattgaagaattagataagagtaaatttaccccagcaagtttagaaggattaacagaagcgttggaaagcactaaagcagtattagatgatccagatgtaacacaagaagaagtagataatgcatataatgaattagtaagagcatatttaaatttaagattaaaagccgaaaaagaattattacagggattatatgataaagtaagtggaatagatatagaacgctatacagaagccagtgcagaaaaatttatagaagcagtagccgaagctaaagcagtattagaagatccaaatgtaacacaagatgaggtagacaatacatataatggattattgaaagcatatttagatttacggttgatcccaaataaagaactgttgacaggaacgatagctaaagcgatggagctaaataaagtaaattatagtgcaaagacatgggcagtagtagaagaagcgctagaaaaagcaaatacagtagcaaatgatcctgaagcagtgcaaagtgaagtggataaagctaaagatactttaacaaaagcaatcgaagggttagaaagtacatcagttgtaaaaacaggcgatacaacaagtgttgctacaggcgatgatgtaaatcttatctactcatttgcaggacttatagttgcaacaatagctttatatggaagtagaaaagaaaaaagtttaaaataatttaaaattatatcggatgaataaatctgataacagtaaaaaataaggaagttttaaagttattgattttaattatcaataaaattaattcttccttttttggtacaaaaaattttattgtatactcttttataaaaatctagtaaaataagaatataggattactggttaataaaaatatggttgatttgttatttagtaaaaaattaaaaggagcgagttaaatgtataaaatcataacagatggttcatgtgatttagcacctgaattagtaaaacagttggatattgaagttgtgcctttttatgtatcgatagatggtgttcatcatcaaaaagagatcattgaattaggaattagagaattttaccaatttatggttgataatcctaaagtttatcctaaaacatcaatgccttctattcaggattatttggatgtttttgaaccgattttaaaggatggcaaagatattatttgtatttgtatatcaacaaaattctccggctcttataattccgcaatgaatgctaaaaatatgttattagataaatatccaaatatgaaaattgaaataattgatgcaacagtaaatacggtactccaaggaatgctcgttgaagcagctgtagtcaagaaaaataatggtgcttcgtttgaagagactattaaatatgtaaatatgatcaaggaaacaggaagaattttttttacgattggtggaatggattatttggtacatggaggacgtgttggaaagttatctggtattgcagcaggagcattgggaattaagccgttgatcttactcaaagatggagaaatatttagtaatggattaactcgtggacgtaaaaagtcgatccaaaaaataatagaacagatagttgattactttaaagataatcaatatgatgtaaataagtatcgtttttgtattggttttggctatgataaagaagaggctgttaaatttaaagaaaaatttattgaagcaataaaagaaatatgtccatcatttaatgatgatgtttcaattcgtcaaattggcgcaacgattggagtacatacgggaccgcatccattaggagtaggattattacaaaaagattgaaagatttattgtgtttagtttatttttttaatttaaaagattaaataataaaaactaccgtcttggtagtttttagatttaaaataaattattttttaaaaacaacgattgctttaaacaaatcaccatcaacttcaatcttgaaaataccattttgtaattctgtaaagctttttacgattgctaaacctagaccgctaccactagtatttctagatttatccccttgaacaaaacgtcctactaattcattagcacttattttgatttcatcagaagaaatatttttaaaaatgatttctactttattagtataattgattacttcaatataaacacgtgtattttcaagggcatatttactaatattgataagcagattttcaaaaatacgataagttttttgactatctaattttaagatgattttttctttaggatatacagttttaaaaattaggttttttcctgtaaaattatctgtaagttcaaattttgtttgttgaatcaaagcaacgatatcaacatcaacaatatttaattttatattcccactattagctttactaatttcaaataagtcatcaattaagttctttaatctaaaagcatttcgattaagtgtattaatgtattcatttcttttattatcattaagattttcttcttttaataagtcaatataagtaataattgatgttagaggtgtttttaaatcgtgtgaaacattagaaatcagttcagttttcattttttgtgattttacttcttcattaactgctttttcaaaaccgtcctttatatttgtgaattcagtttttaaaggattaaataaaccaagatcttgattgatttcaacatcaaaatcaccattagataatcgctgtacagaatttaataatatttgataatcttgtttaatagcttcaaacttattttttaaaataataaataaaattatagagtaaattaaagtgaaaaatacaccaaaaataaagaaacaacaaataatagaaattattaaaccatttacaataactatttttagaacaattttatttatattgtcattgaaatcaaaactaattattttgttgaatattttttttaatgttctaattatccagcagcaaagcatgttgttttttaaaaatgatattattccttctttaaaaatcgattttatataataaacagtaaacatgcaaagaaataagaaaattatccaggttccaatattcattgtacttaaaataatttcactatattctccaaaacctactgaagataattttgaaatgtaataaccatttaaagtatcgataattaaagcataaataatagcaataacaccagcaaataaaacactcaaaatgcaaagtaaaatttctaatttgattttagctaaagatgaaaatatatttatttctttaactatttcataaggataaaaaagaataaataaacttactacaattatagcaataattacaaagggagtgatattttcaacattagcagctaatgaatttcctgttgcataccatgcaatcgtatcaattgaatcgctactaagtttatacggtacagcaagatagatagtaaaatttgtgggattgtgcaaaacgacattttcatcatatgcttctaaatattgaaagtatgcttgtttatagttattccaaatcaactcataattttgatttgccgatgttgaacagcctagggaatcatagcttaattgtccattttcatcaaaattaatttttaaataccactgatatttttcttttaaagcatcattatcataaatgtttttgatatcattattagtgttgcttaaagagttattgtttccttcggcataatattttatattttttttatcagacatgatttcgcgattatatagaatactgttttgataaaattcattactagcttcactatttgcggtaatatatttaggaattccttctttttttccaatattatccaattggaaactgacaggataaatagtatctaaaatatcataaagaatttgatttttagaaaaatcaatgtttttttgattatcagtttcaataaaatcataactaaaataaataccaacactactagttaataatattaagactgctataattgaaaagattattttttttgtattcatcatatcacctactgtttttcaattttataaccaacaccccagaccacttttaaatattgtggattacttggattgatttcaatcttttcacgtaaatttctaatatgaaccataactgtttcagtattaatggcggcttcctgccagacgttttcatatatttgttcacttgaaaaaacgcgaccgggttttttcattaataattccagaatttttaattcgattggagtaactttaattattttaccatcaaccgttacttctttagtatctagatcaagttctaatccaccaactacatatttattgctttcatcttgttttttatctaacatatttaaatatttatggtatcttctaagttgagaggatactcgggctaaaagttccattggtacaaatggttttgttacataatcatcaccaccaatattcaaacctgtgattttatcaatatcttctgatttagcagataagaaaatgattggaaagtcatatttttcacgaacttttaatgtcatttcgatgccattcataataggcatcattacatcaacgattgctaaatggatatcatgctgttctattatttctaaaccagcttctccattattagcaatgtatacatgatatccttgagattttaaatatatttcgattgctctagcgatttctatttcatcttctacaattaaaatattatcttgattcatatttctaccttctttcataactattataagctactatatctaagaataacagaaatgaaatcaaaagattttctaaagatttttttgctgtttatttatataccatttataagcaaacagaccaacgatcgatatgataccggtaattataaatactgcaatagtaaaggggtaattttgttctgacaaactgtgaccgccaatagtacttgttataattgaaggaattcttgctacagttgtaattaacaaaaagctagataatttaattcttgtaagaggtgcaaaatatgtaagaatatcttttggtgtaccaggaataaaaaaaataataaaaagaatgagttctaaattttttttaccttttaaaaatgatatttcatgcagcttttcttgattgaaaaatttattaataaatctgataccatatttttcaacaaaccagtatattataactgttccaatcattgcccctagtaagcaaattactagaccttgaatttcaccataacaaaagcctgaagcaacttcaataatttcacctggtaaaaagacaaatacaacttgcactgccataattaaaattagaaataatttgccccagttaccaaattgatctaattgtgcttttaaatgttcgggattatttaagagatatacaaaaggtttgtatagtattagacaaaaaccagccatgatgaatgttgctaaaagaagtcgataaattaattttttattttctttaattatttccattttttcacctcgcatttagtatagacagttaatctaaaagaaaacgggtgaaagattaaaaataattctaaaaaaattacaaagtttaaaaaaagaatataattttaagattgtaaatattattaaaagctatagatattagaaaagctttgaattaaagaagcgctcttaattgagcgctgttgaaagggtagatttatgtgatcatattatctattttaaaattatagtagttatttaaaatatatcttatttaggcttgattattataagtgagtgtatctagcttatcaagttattgctgttggttccactttatttttatatattgattatagcattaaaataatggattattacaaattttgtattaaacggtcgatattaagattaaacggtaatatttatataaaaatattttatgatatgatgaaataatactatagaaactaaaaggataaagatataaaaaagctgtagaaataaaaaatgaattaagcaagatcataaaaaagcatccgtaatggatgctttatgacagagacaagattatgattaaaaagtatattagattaatgctagaatattaaattacagtaaccccatttcaatcatttttaaaccgatatctacagagttataagcagcacctttcattaattgatcagcaactacccataaacttaaggcgtttggattatctaaatctttacgaactctccctacatgaactaattggtcaccgacaaataaatttgccattgggtaaacttgattttcaatatcatcatatagttctacaccagtagaattacttagtaattcaaatactttgtcaatatcgattggtttctttgtttcaatatatactgattcagaatgtccacgaagaacaggaacgcgaacacatgtagcattaactttaatatctttattaaagatttttttagtttcattaaccattttcatctcttctttagaaaaatgattatctaaatcaaatttatctacttgaggaatacagttaaaagcaattgggaaatgttttttatctccagcacaaggtaatgtttttgctactggttctttaccatctaaaacctcttgagattgacgatataattcctccattcccgcaactccagctccagatacagcttgataagttgaaacaataattctttcaatatcaaaatattcatttaaacgatttaaggcactgaccatttgaattgtagtacagttagggttagcgatgattcctttgtgatttctcaaagcttcaccatttacttctggtactactaaaggtacatcaggatccattctaaaatggctagtgttatcgatgttgatacatccagcatttactgcatatggcatatatttttcagaaatgctgccaccagcagaccaaaatgctacttcaacattttcaaaactgttttcagttaattcttcaactgtaaatttatgatcttcaaattcaataacttttccagcgcttcgagatgaagctaataatttaatactttcaaatggaaaattaaattggaaaatacatcttaacatttctcttcccacagctccagtagctcctacgattgcaactttatattttttcattttattttacctttccttcctaaaaatgcttcatgtaataatatttgtgctctttttacatcatcacgatctatataacaagaaatattaatttctgaacaagatgtcatctcaacattaataccattattattcaaagtattgtatgctttttggaacataccgcggttgtttttaattcctacaccaattacagatactttaccgatattaccacgaacaataattcgattggcatttaattgaggttttaaatcattaataatatcaacaacagcaggaacatcaacatcactgattattagcgaaatatccatttttcctccaccgactaaagcttggttgaaaacattaacatttacaccagcatcagcaattttttcaaaaagatttccagcgctattgtttgttgcgtctacttttactaaagtgatacgggcttcattttgtgaacccgtgatcccagaaataattagctgatttaaattttctttcataatacggtcatctcctattacatatgttcctttagtatcttcaaatgaagaacgagcgtgtatcgcaatattgtgactagcagctagttgaacacagcgatgatttaaaactttagcaccgtttttagctagttccagcatttcagcataactaatacaatctaattttatggcaccaggtactaatcttggatcagcagtatatataccatttacatcactataaatttctacttctcgagcatcaatggctactccgatagctactgcagataaatcactcccgccacgtcctaaagttgtaattttaccatgtacagaatgtccttgaaaacctgggcaaaaaacaatatctacatattttagtttttcaagaatatcttttccctctactttattaattgtggcatttttaaatgttgaatcagtcacgattcctaattcatcattagtaatcgtggcaacacgatatcctaatgatgctaattcacttttacatactaaagtagatattgtttctccaatactagttaatcgatcgatttcttcgtctgttaattgttttgtattaacgattgataacagagtatcggtagcatagggatcatcatagcgccccatagctgaaactactgcgacaactttattaccattattaatttcacggataatattgttgtacattattgaacgtgactctcttgaacgagtagaagtcccaccaaatttctggacaattatgttcattttatcccctcactttaaaaattgtgtattcttcatcgtttaagacggttgttaaatcagctaactcaatttcatgagtaatataaatatgatcatgtttttctgtaaaatacatctcgtaatcaacatctaatggtttgtttgctcgaagataatatttagatttagtaataggatagacattaggacagtcttcataatcatgatcccatctttctgcctgggtagttttgataatatcactaactactgctgaagcagtaacatatctaccagcgcctttaccataataaattacgttttcaacataatcgttatcaatctctattacattatatgcatccataacatttgcgactagttcttttttactaatcaatgttgcggctacatcgattccgataccatcattgacttcttttgcttgagcaatcattttaaaacgataccctaatttttttgcataatccatatctgtttttgtaacatcacgaataccagtagcagaaatcttgtcaaaatcaataaattttttaaatccattttgagccaaaatacaaattttatgtgcagcatcgattccatctaaatctaaagcagggtttgcttcgacataacccaagccatctgcaatagttaaggcttcatcaaaatctaagttttcgttttccattaaagttaagataaagtttgtcgttccatttaaaataccaataatttctttagtattgttagctactaaactttctttttggctaactaatacaggaattccgcccccaacactggcttcataaaaaatatgaacattgttttctttagcagctataaagatttctttaccataatgggcaagtaatgccttgttagctgtaacaacgtgcttaccatttttaattgcgtttagaataattgttttagctattgttgttccaccaattaattctactacaacatctatctcactatcattaataatatcgttataatctttcgtatagattattccttctggtaattcaacttcttctaatccacaaccatatttgattgtaacttcttcattgataatttttgataaacgttctttttcattagtaagaatctctacgaccccataaccaacagttcctaacccgataataccgattttcatcctatacccccttattcataataaaaatggaccttatataaaggtcctacatcattattaaatagtagaaccataatctttataataggcgcaataatggaactaattatagccataattgttgaattcttgcctattaataacatactgcggtcctccatttttctaatttatgacatattaacacgattgtatacaataagtcaatgataatcaataataattgaaataatgtgtattgtaaaatgaaactggaattaaggtaatgtaatgattggctagccaatcattacatttcgccgccaactccctctagtctcaatttttaattttttacatgaaaaatgttcatagaagtcgtattattttagtcgaccaaaacctaataaaggagactctctatgaacacttatactatatcacaaaaatctaaaaataaacaccttcagttttttcattatgaatttattgttaatgaacttattcgttttaacgctctgcattctggtcataagcgtaatatcggtaaaactcaattcattcattatttggctgtttctgttggtacttctgtctctaatgtctattctatcattaaggatgccactatcactgttagagatacctatcttaatgaacgtactgaactttctgctttggctgcctttgaaaaaagatctaagatccataagacccctaacaattctaaacttcataaggctcatgattttatcactctcgttgaaaatgaaatgaaatcaaatagactttcctctgttgatgagactatcaattatcttcgccttcatgaaaaagataaaattaaaaatatggtaactgtttctactaagactttctataattacatacacgaaggaaaagtttcgataaaaccaattgatctgcctagaatgctaagaagaaagacgaaaaagaactggaaaacttatatccctaaaagacagaagggaacttctatcatggaaagacctgaaagcgttgatacaagagaggaatttggtcactgggaaggtgatcttgtcactggtccaagagatggacaaaatggtgcctatttgaccctgattgaaagaaaaacaagattttattatatgattcctattacatcaaaatcttctaaaaaagtttatatgcagatcaataagcttcataaattttatggtgacgattttaagaaaatattcagatccattacattcgataatggaaatgaatttgccagatggaaggatatggaaaagaaaccaggatcaaaagaacagcgtacaaagatttattttgggagaccatatcattcatgtgatagggcatcaaatgaaaactgcaatggacttataagatattttataaagaaaggaactgatattaatacaatagataaagaaaaaacattagatattaatcaaaaaatcaatcaaaagaaaaggaagatacttggttatcttcctgcagaacagctatttgtcaaagaactggctaaaattggtataactaaaaatacgattttctataaaaattagaacttttttatcttatttccactctctgcttgcaattcgggaaataattttatcgaattatgttataataacaatatattgacttctttaaataaattgtatacaataatttaaatcaaacagggggttgaacaatggaaaagaaatatgtaagtacgcgaaatcttcaaaaagaaattaatttttatcaagctatcgttcagggaatcggtgaagatggtggtttattagtacctaattttgattttactaaaatggatttagaagcgttatctaatttgaattatgtagatctagctacagaagtattaagtacttttgtaccagaagatggaaaagaattgattcatgaagcatgctcaaatgcatatggaaaaggactgtttcctgaaattgtcgtgccagtaaaaaaagctggtgatgtttatgtggctgaattatttcatggtcaaacggcagcgtttaaggatatggcattgtcattattgccttatttaatgactttatctttaaagcagttaaatgaacaacgtgaagtaatgattttagcagcaactagtggtgatacagggaaagctgcgttagaaggttttaaagatgttgctggaacttgtattaaagttttttatccattagatggagtatctgcaattcaacagcagcagatggtaagtcagactggtaaaaatgttaaggttattggaattcatggaaactttgatgatgcacaaacagctgtgaaaaaagcatttggatctgatgaattaaaagttgaaagtgataaacataatgtctttttatcatcagcaaattcaatcaatgtcgggcgtttgattccacaaatcgtttattatttccatagttattttgaattggtgagaaatgatgaaattaatttaggagatcaggttaatttctgtgttcctagtggtaattttggtaactgtttagcaggatatttcgcaaaacaaatgggattaccaattaataaatttatttgtgcatcaaataaaaataatattttgacagatttctttactacaggtcgttatgatgctaatcgagaattttataaaactaatgcaccagcaatggatattttagtatctagtaatcttgaaagactagtttggtttatgtctgatggcgatggggataaagtgcgtagttatatggataaattaaacagtgaaggtgtttatgaagtagatgaagatacttatgaaaaaattaaaaagcaatttaaagcaggatatttaaatgaagatgaagttttacaaacaataaaacagtgctttaatgaaacaggatatttattagatactcatacagcaattggttatggagtcttaaagcagtatcaaaaagatagtggggatgatacgaagacgatattattatcaactgcatctccttataaattccctgaatctgtatacaaagcaatttatgatgaagaacttgatgtttatagtgctattgaaaagttaaatgaaagaacaggtgtttcagttcctagagcattaacaggtattaaagatcgagctgttttacataaagaagcaatcgataaaactgaaattattagctttattaaatcagaaattgaagcaatgtaggaggttatcatgaaagtaaaagtaaaagtacccgcaacaagtgcaaatttaggtccaggatttgatgtggctggtttagcactgactttatacaatacctttatctttgaattaagtgatagtggtttaaatattacaggctgtccagagcaattttgtaatgaagataatatgacttatcaggctttcaaaagagctgctgaagtttgtggtttaaaataccaggggataaatatcgaatgtagtggagatgttccttatactcgtggactaggaagtagttcgacatgtattgtagcaggaatcgttggagcttttgcttttaaagataaggctgatgatcgtcaagagattttagagttggcaacagcgattgaaggtcatcctgataatgtggcaccagctgtttttgggggattaacagtgtcggtgatggaagaaaataatgttttaacattaaatattcctgttaagcatgattatcgttttgttgctttaattccaccatttacattatcgactgaacaatcacgttcggttttaccgcaggttttaccacggaaagatgcgattaaaaatgtatcacatctagcgttaatggttgcttcattgattaatggttatgatgaagggcttaaattaggctttaaagatcgtttacaccagccatatcgtggagatttaattaaagggtttaatgatattatggcggccttagaaaaagatgagaaagtcttaggtgcatatttatcaggagcaggaccaactatcatggctgttattcgtggtgaggataaaatgggagtagtaagaataaaggaagaacttggtgatttagttaaagattggcaagttgttaaacttgaattggataatcgtggatacactgcagactatgaataatgaaaaggagttataaagagaattagattctttctaactcttttttattaaaataaaaagtaataatcattttagatgattattacagaatggtttattttatataatttatcgatgtttagagcgattttcttttttagtatagtcagttttatcattagttctacctaatagataatcgacagtggtttcatgaaaagttgcgattttatccaagatttcaggagcgattgttctttcgccacgttcataacgtgaatatgatttttgtgtaacattaagataattagctaattctttttgagttaaatctttgtcttcacgaagatcacgaattcttttgtaaataaccatagttatcaccacctgtttttattataggattgaccccattggtctatgcttaaataccccaaattggactaaaaaatatgattgttattatttgttgattaaaaataaaacctgcattaatagcaggataagagtttttatataaatgattttaacgatgtatttggttttctttttttgtataatcagttttatcgtcagttctacctaatagataatcgacagtagtttcgtgaaaagtagcaattttatctaagatttcaggagcaatcgttctttcaccgcgttcataacgcgaatatgatttttgcgaaacattaagataattagctagttctttttgagttaaatctttatcttcacgaagatcacgaattcttttataaataaccataacatcatcaccaaattaattataaatggggtcaaatttctttggttgtaattgcccaaaatgaactaaagaaaaagttatacctttagctttataaataaaatcgtttggtttataataagtgggaggtgaattatggaacagtttgcaagaattgtaaaaatgactaatcaagaatggcttgaaaacctccaaactaaaaaggtggcagtttttggattgggtggggttggcagttatgtagttgaggcgttggttagaaatggaattggagaaatagttttagttgatcatgataaaatcgatattactaatctaaatagacaactatatgcattacattcgacgatcggtatgaataaagtggatgttgctaagagaagatgtttagatatcaatcctaatctaaaaataactacatatcagcagttttatcttcctgatcagggaatggaagatatattttctgattgtgattttgttgttgacgctatcgatacggtaaaagccaaaatagcattaattgaaaattgtcacaaattaaaaattcgtattatttcatctatgggaacaggtaataaattggaaccagaaagttttgaaatagctgatatttttaaaaccagtgtatgccctttagcgagagtaatgcgaagagaattaaagattcgtggaataaaaaaatgtcctgtattatattcaaaagaacaaccacaaaaagtagctgatgcaacaccgggaagtgtgagttttgtccctagtgtcgctggtttgatgatagctggttatgttattaaagaactcgtaaaggagaataaataatggaaggtattacagaaattgataaaacagaatatatagaagattgcttgaaaatagttaaagaaatggtgctaaatgaagattttacagatgaaatctggcgtttattaactagtgagatcatggatacttgcttgtttattggtggagattttggtgaggaaaatatacgtaatattacaaatcagtatattaataatgatggtattaaacgctttaaaagagcgcataaggtgttataatgcaacattattgtgaaataccaacaccaaaaggcacaatgagaggtttttttcataaaccaaataaagataagcatccagtttgtttgatttttcatggttttactggtcaaaagacagggactaaatttagctatgtgcaattagcaagaatgttagaagctaagggcattgcaacttttagatttgattttttaggtagtggtgaaagtgatctaaactttaaagatatgacttttaaagatgagttggcatgtgcaagaataattttagaagaagctttaaaaatggaaaattgcactgaaatatatgtcttaggacattcgatgggaggagctgtagctagtgaattagcgaaactttatccagaagtgataagtaaattggtattgtgggcaccagcatttaatttacctatggctttagattatttaacaggtaaagttgaagcaaatcaagatggattatatgatcatggcggattcgaaatttctcaagagtttgttgatgatatgttagctcgtgatttttatgatgatttagatatttataaaaatgatttactaattattcatggtacagaagatacgactgttccgtttgatatatctaaactatatgtacctaaatttatagatacagctaaatttattccaattaacggagctaatcataattatgatagtgttgaacatataaagaaagtattaaaattatcgcttgattttttggttggacaataaaataatgttatctatgtagatgtaattaaattatgtcgttttattgtttaaagaggaaaattttatctaatataggtaatttatttatggaaaagggattgacattatacgatgaagtacttataatgagaatgttcttatgaactctaaagtccccggtaaggataaaggagaaaaaataaatgagacaaacaactatggctaatgcagccacaatcgaaagaaaatggtatgtagttgatgcaactgatttaactttaggtcgtttagcatcagaagtagcatcagtattaagaggtaaaaataaaccaacttatacaccacatgtggatactggtgattatgtaattattattaacgctgataaagtagtaatgactggtaaaaaattagataaagtaaattattatcgtcattcaggttggctaggtggtttaaaagtaaaaactgctcgtcaatttaaagaacaaaatccaactggttgggttgaagcagcggtaaaaggtatgttaccacataatacattaggtagaaaacaaggaatgaaattatttgtttatgcaggtaatgagcatccacatgcagcacaaaaacctgaagaattgaaaattaaagggtaaggaggaaaaacagaaaaatggcaaatgtacaatatagaggaacaggacgtagaaaatcttctgtagctcgtgttattttaacaccaggtactggaaatattgtaatcaatgataaaccagctaaagaatacttaccatcagatgttttattgatgattgttaatcaaccattagagttaactaatacaacttctcaatttgatattagtgttaatgtatatggtggaggatattcaggacaagctggagctattcgtcacggtatttctagagcgttattgcaagctggtgatgattatagaccaactttaaaagctgctggattccttactcgtgatgcacgtgttaaagaacgtaaaaaatacggtcttaaaaaagctcgtcgtgcgccacaattctcaaaacgttaatcaaaacaaatacgaaggaagattcaaggttatcttggatctttttttgtattttaattaaaaataaaactataataataatgaaaagtatgttataataattttatacaaatatggagttataatgaaaatttgtataaatggaggcgctatgtttaagagaacaatttttaataaaatcgaagaatcgttaaagcattatcctgttgttattattacaggaccaagacaagtgggtaaatcaacagaagcatataatttggtgagaacgcatggttttcattacgtttcattagatgatatagaaatgagagaacaagccttaaaagatccaatattttttattcaaagatatggatatcctttgattattgatgaaattcaatatgctcctatactgatggaagtaatagaatcaattgttaataaaaaaaggcttgaagaaggaagtgccaatgggatgtttgtattaactggttcccaaactttttcattaatgcgaggagtaacacagtctttagctggaagagcaactatcttatcaatgaatcctttaagttatagtgaaataattgggaaagatgagattccttttttgccttctttagaattattacaaaaggaaatgaatcctatcaatgtcaatgaattgtttaaaataatagttagaggattttatcccgaattattaaaaaatccaaaattaccaactagacaattttatagagactatgttaacacgtatttagatagggatattaatgaacttataaatcttaaagataagttgaggtttcataattttttacaacatattgcaacattaacaagtcaacaaattaattattcacaaattgccagaaatgtgggtgttgatgttaaaacagtaaaagattggatttcgattttagaaacgagtggaattatatatttattgcaaccatatagtgagtataaattatcaaaaagaattgttaaagcccccaaattatattttagtgatactggcttagcagcttatttgtcaaaagtttatgattctgaaaatttattaattagtaatttagcaggggcattcatggagacatacgttatgaatgaaataaagaaatcatatgaaaataatggattagaattaccaggatactattatagggacaataatcaaaatgaaattgatcttatcattgttgaaaatctaaaacttcattgtatagaaataaaaaaaggtagtatgttcaatgagagtcatattaaaagttttagtcaattaaaaaagagtcaatatgaagttggtatatcttgtattatatgcaatacagaaaataattatcctattaatagaaatgtatttgtattatctgtttcttgtatataacagttgtattgaattgatttaaagtgttttggtaaataagctagtaagatgcaaaaatatcaaaaagtgttgattttatcacatttgggaattaacaaaacgttaatcaaaaacaaatacgaaggaagattcaaggttatcttgggtctttttttgttgtatattaaatcatgaaattgtaaaatataaaaataagatatattatgaaatatcattaagtgattataatatgtttagatatatccaaatgtagaaatataaagttatattattatttttggtaaaagatttttaaaattttaaataaaaagaaggtgaatttgatgaatgatcatataattaaagtggatggctttattgaatttaataaaactgatgatattgtatcagatatggaatttattattgatagttcacaaaaaagtgcatatcaggcaattaataccaatctcatctatcgtaactggttaattggatatcgtattgctcaagaagaacttaatggtgataatcgtgcaaaatatggtggcgaagttattaaaaatctttcaaagaatttaataaaagaatatggaaaaggatttacaaagtctaatctatatagtttttataaattttatacaatgtatccaaacattttccagacagcgtttggaaaatcaccaatagattttttgtcttggtcccactatcaagttttaacccaagttaaagatagtgttgctagagaatggtatgaaaaagaagcaaaagaacaaacttggagtgttagaacattacaatgaaatatctcttctcaatattattatcgattgttgaaatcacaaactaagcaacctgttattgatgaaatgaataaattaactgaatctaaaaattatgataagttagaatttataaaaaatccagtgatagctgaattcttatcgttaccgaatgatatatcttttactgaaactgaattagaaacaagtattataactaatttacaaaaatttctaatggaattagggaaaggttatgcttttgtttcaagacaacagcacattcatactgaaaaacaagactattatattgatttagtattctacaattattatttaaaatgctttgttttaattgatcttaaaacagaaaaaataagtcatcaagatgtaggacaaatggatatgtatgttagaatgtatgatgaattaaaacgaacagaaggagataatccaaccttagggattattctttgtgcagatacagatgaagatatagcacgatattcaattcttaagggaaatgaacagctgtttgcaagtaaatataaattatatttaccaacagaagaagaattaagaaatgaaatagaaactcaaaaaataatttttcagttacagcaaaactcagaagatttggaaaataatgataggtgatataaaaacggaatcaaaagttttttaaatgagtttttcagaatgatttaaaattagttcaaaaggagatagattagaaaaatatagagtaaattggctttaggaacaatgaaagttatattagtagttggtgtatcttgtattatatgcaatacagaaaataattgtcttattaataaaaatgtatttgtattatctgtttcttgtatataacagttgtattcagttgatttgaagtggtttggtaaataagctagtaagatgcaaaatgtttaaaaagtgttgattttatcacacttgggaattaacaaaacgttaatcaaaaacaaatacgaaggaagattcaaggttatcttgggtctttttttgttgtatattaaatcatgaaatagtagaatataataatcagatatattattaaatatatgaggaggtgctattattgatagaaaaaagttatatagaaacttttgaaattattaaaaaacaaatacaaattgctcagcacaaggcaatactgaatgctaataaagaaatgatttctttgtattggaacattggaaaaattattgatactcatagtaaatggggaaataaatttattgataatctttcaaaagatataagaaatgagtttccatctttaaaagtttttcatcaagaaatttaaaaaatatggtaagattttatcgagagtatactgattttgaatttgtgcagacggtgactgcacaaattccctggtcacataattttgagatactaaaaataaattcaaaagaagaacgaatttggtatattaataagacagtagaaaatggctggtccaaaaatattttggctcatcaaatagaaactcaattatataagacaacatgaaaatacaaaaatctcaaattttcctcaaagattagaagaaacacagagtgaattagctttagaaacaatgaaagatccttatgtttttgattttattgatttgaaagaaaatgcaagggaaaaagatttagaggatgctttaatcaataatattactaaagtacttttagaattgggaaaaggttttgcgtttgtaggacatcaatatcatttagaaattgcagaggaagatttttatattgatttgttattttataatataagattaaggtgttatgttgttatagaattaaaaataggtgattttaaaccggaatatgcaggacaattgagtttttatttgacagcagtagatgaaactttgaaaggtcattttgataatccaacaattggactattattatgtagtcataagaacaatattattgctgaatatactttaagagatatggataaaccaatgggagttagtgaatacaaaataacagattatttaccagaagaattaaaagaaggtttacctacaataaaagatttagtttcttctattgagaaacagatagattgatatgaccacaattaatttttaagactttttagttaattgaatataacagatttctttagggtttgttgatgtgagaagttttaagttgtgctgagggtagtagcaataaggcagcaaatgagaaatttcattgaaaaaagtattgataaaatcaatggatttgagttataagttaacaacttgattttaacaaaacgttaatcgtagcatttacgaaggaagatttaagattatcttggatcttttttttgtgatttttaatgaaataagagtgagtaagtgatataatgagctaattaataaaattttaaatggagaaggtgatattatggttgatatagtagaaagaaatgaagttgtacaatttaaagatggagattttgtattagatgttatgtttcaccacaagaagaaactgtatggctaagtgcaaatcagatggctaagctatttgataaagatgaaaaaacaataaggaaacatataaataatatttttaaagatgatgaactttcaatagaaaacaacacgcaaaaaatgcgtgttgttggtgttaaacaattagtagcgttttattctttagatgttattatttcagtaggttatagagtaaaatctaaaaatggtattctttttagaaaatgggctaataatatattaagagaatacttattaaaaggatatgttgtcaatgatagacactttcaagatattgaatatgttacaaaaatgcttgatcaatataaagaagctggtggaaaattaccaactagtgatgctgtgttagagtttttaaaagcttatcaaagaggatttaaaatactagatgattatgatcatcatactttagaagtacctgaaggacaaaaagatgtctatgtcattcaatatgatgaatgtataaaattgatacacaatacaatgtttgcaaattaaggagatcaatttgcaattgaaagagatgattcatttaaaagtagtatatcaacaatatatcaaagctttggaggaagtgatttatatccaacacttgaagataaagcaagtgcattattatattttattgtcaaaaatcatagctttattgacggaaacaagagaataggagcaactatatttttatactttttggaaaagaacaatgcactatataaagatggaaaagaaagaattaataatgatgctttagcgacattaacaatattagtagcaacttctagaccagaagataaagatattatgatgcaacttattaagacaattattaaataagagtgatatgctttagtaaagaaatattttaaccacaattaatttttaagactttttagttaattgaatataacagatttctttaggatttgttgatgtgagaagttttagaatgtgtttagtgtggtaacaataaggcagcaaatcaaaaatttcattgaaaaatgcattgataaaatcaatggatttgagttataagttaacaacttgattttagaaaacgttaatcgtagcatttacgaaggaagattcaagattatcttggatctttttttgtatttaaaatgaaaataaaactataataatgatagatataatccaaatggtacaaatttggaattcaactccaaattagtataaaaagaggtttttttcataatgataaaattaaagatgcatatctttaggcttttgtgatatagggaagtgttcataaaaagtctcttttatttggttttagttgactaaaataatatggtatttatgaacatttttatgttaaaatcgaagctaagataatatgatgttgaaaattaatgccagttttattttacagtgtgtaatcaaaatttttattgaaaaatatgttgatgaatatgaaattaaatatatcgatcaaaagataactatattgtagtaatgatttatgagaagttagatactttttcttgagttttgcttaaatactataatgaaaatactaataatatataattataagctaatatacttataaatgatagttattagttaattgactaataattgttgtttgtaaagtaaaaatatattatactgtagtaaatacgaggaggtggagcatgtgttttttgtctttaataattttaatccatatattgctattataggtgatattaagaaatcaaaaagtattgaagagcgaaaagtttttcaaaacaaattaaataaagtattaagtgaaataaatgaaagatattctgattcaatagcttctaactttacaattactttgggagacgaatttcaagggctgctgcattctggaaaaaatattatggatataattcaatatataaaaaggggctcttatcctgtaaaaataagatttggtattggggttggagcgattactacagaaattaattctaaaatatctattggtgcagatggaccgggatattataaagcacgagatagtatagaaaatcttaaaatattagagaagaaaaatgaacgtacatttggtgatgtgcaaattaaaatagatggagataatcctttacaagaattatcattaaattctattttaaaactcatgtatagcatcgaagaggggtggacaaaaaggcaaagagaagttgttgattatgttttatttgaaaagaaaaatcaaactgaaacagcacaatattttaatgttactcaatccaatattcaacagattttgtctaaaactcatttttatgtatataaagacgcctttgattctgttaataaaatattaagtgaggtaaagggtgataatgacttataaagaaatactgattatatttttacttgcacatatcttatctgatttttattttcagactgagtctttagcaagaaaaaaggaagacaattttaaatatgtattcattcatagtgtgatttatggattgataactttaattgtagctaaattgatctgtcaaaatattgaaaatatatatttagagataattataatttctcattttttagtagatgcaataaaatatttcttaaagaaaaaggaatttataagaaaatatcaaaagtatatttttataatcgatcagattattcatatagctatattaatgatactttcttactttatgataaaatcaggagaaaattatcgatataatctaatgcttttaaatatattaaatattgttggaatttctattcagtctataattattctaattgttcaaatacttcttgtacataaaccaacaaatatcttgatagttaatataatgcaatcatataagcctgtaagtaaagaagatgataatactaagaatacaaaaaaagcgggaaggatgattggtactattgaaaggattattatgttatttttcttactaattgaacaatattcttcagttggattagtgttaacagctaaatcaatagcgagatataataaaatatcagaggataaagagtttgctgaatattatttattgggaacattattgagtactatttgtgttttaatgatttctataatttaaatggtgaggataaaatattaaatgttttgatataatggtctacgttgctttaacaatgcaacaaaattactttattctactgtgtttttataattatttaaatgctaataaaatagtacgaagaaagatttaagattatcctggatttttaagagcttattgatgtaagaacttttaagttatgctgaatagcaataaagcagaaaaattaacgaacataattctcaagtaaaatgcaaagtgatatcaactatgagcggataaagtaagaaatgttaatattattgatgttttcgatattttatagtatattataaatgagaaaaggactatcgataaacggttgtcctcaagtgaaagttatttaaaagaaataaccattacaattggcgttggatggttattttcttttggaaatctttataattaaagagattaatgtaataagcgttataacgaattgaaataaatcttatcatgagtgttttgacagcttgtgtttttcttaaaagatgactgtttaaagatgctgctgtttttctgtaaaagattattaaatagattaatcatctgttagataatttgaatatgcaagtatttgtgaaagaaaatacaattttatttataaaataaagttcctatctttgttgatgggaactttgataaaatgagagttgaatatgactttggataaacatatataattgtaatggtttcattatttttatttaattaggatttatcaatattttgatttattagtatgattttttataaataaaaaaagccaatgcaaattggctttaatcaatagatatatattttttttcttcaacttgtttaacagtgtttttaggaattgtaatctttaattcaccattatcaaatgaagctttaacatcttcttgtttaatatctccgacatagaaactacgactacagcttccactgtaacgttcacgtctaattacatgaccttggtcatctttttcttcagtatttgcatttctagtagcactaactaatagataaccatcctttaattccatttgaatatcttcttttttaaatccaggaagttccatgtttagtaaatattgatcattttgttcacagatatctgtgcgcatagcattcacgttagaataatttttaaaagaatcataaaataaatcatcaaatacatcattcataataggtaaaaatttcataaaacatcgcctctttctttctttatctcagtagttttacgctgggatataaaattatttaccttgttaaggtcctttccttaactacacttatattatagcacttattttagcactgtcaacgcctgagtgctaaaaattaatgattttttatgaaatcttataacgatattatgaaacccttttttgttgtaaacgaaattttaatatgatattcttatatagaaaagacgatgataaaagaaaatcattgctaaatttaaagtaaattgttagtttttgctgctttggcaaataaagagaagatactgcggtttataattttgtaaagtggtaaagcttacagtttgttttttatagattaattaaaatgattgcctacagaaacaagcgtttattcataattagatagactttggatcggcaggtagaaaggatataaagttattatgaataaaagacatactcaaatattagagttattgactaaaagaaaaaaaatagaagttagcaagctttcgcaaatactgggagtgtctcaagtgacgattagaaaagatttagcgatattggaaaatagtggggttcttcttagagagcatggctatgcaactttaaatgatagtgatgatattaataatcgcttagcgtatcattatgatagtaaacaaaaaattgctaaacttgctatagaaactattgaaaatggggaaacggtaatgatcgaatcagggtcttgctgtgctcttgttgccttagaaatagcccatactaaaaaagatgtgacaattattacgaattctgcgtttattgctgattatataagaaaaacgggtactgtaaaaattatcttattaggtggagaatatcaaaacgagtctcaagtaatggttgggccgatcatgaaaaaatgtgctgaaactttttttgttgataaattattcatcgggactgatggatttagtgaaaaaagtggttttactggtaatgattatatgcgaagtgaggcggtacgtgatatggctaagcaggcggaacatgttattattgtaactgattcagtaaaattccatcaaaagggtgttgtcaatctggttgatatccatgatattgattatctatatactgatgcaaatatacctaaagaagtggaagattatttacataaacagaatatagagatttttaaaactgaataaaaaaggagtatcactcctaaaaaaaacaatcgattcctttatctaaaaagatttgctggtattcttgtaaatcttcaggataaagggcttttttatttttaaaacgatattcacgattcaataattcatattttttttcaccaaattggtgaaatggcaaaagttgtacttttgataattgaacttctgttaaaagcttagcgatacctttagcatcatccaatgatgcattaaagtcaggaatgactggaattcttggcaagatttcaatcttttgcttaactgcccatttcaagttttgaataattaattcgttatggacgtttgtaccaagaaaatgttgataagaatcatagtgtttaatatcaaataatattaaatcaaacataggggctaattctttaaaaatattaggttgaacataaccggtcgtttcgattgccagatgtaaatcgtgtttttttagttctttaactaattcttttaaaaaggcgggttgactcattccttcgcctccagaaatagtaattcctccgttagattcttcgtaaaaatctttatcttgtaaacaaatcttcgcaatttcagttattttcttgttttcaccttcataatctaaagcgttttgaaaacaactgtcaacacatgataaacaactagtacatttttggtgatcaattatgattttatcgttgatcatttgaattgctttatgttgacaggcattgatacaagattgacaatgaatacattttttttgatcatataaaatttgaattttttcaagttgtgattcaggatttgaacaccagccacattttaaaggacaacccttgaaaaagatggttgtacgaataccgggaccatcatgaatactaaatttttgaatattaaatattatcccttccataagtactgtctccttttttatatttatatgataacattcgttattttaaatgtaaataataattacgaatgaaagtaaaatatcttttaattaaaaaatctatattgacataaaagctgtttatgataatatataattgtaattgaaaatataaataatttcaaatgaaataaggaggatgaaaatgaaaaatgttgcccattttggagatttaaccccaagaatgaatgagtttagagaaaaagttttggataaaaagccctatatttgtgctcaacgcgcattgcttgcaacagaagcatacaaactgaatcaaaatcaaccagccgttatgaaacgagctttgatgttaaaaaatattttagaaaagatgtccatttatattgaagatgaaacccttatcgtagggaatcaggcggcttctaataaagatgcaccaatttttcctgaatatacactggaatttgttttagatgaattggatttgttcgaaaagcgagatggtgatgttttttatattactgaaaaaacaaaagaagatttgcgttcaattgcaccattttgggaaaataataatttaagatcaaaaggtggtgctttgcttcctgatgaagtaaaagtttatatggaaacaggtttttttgggatggaagggaaattaaattctggagatgcccatttagctgtggattatcaacaagtattaaaaacgggattaaaaggatatgaagaaagagtacgacaattaaaagatggattggatctatgtgttgttgaaaatatagacaagtatcagttttataaagcggtgttgattgttattgaagcggtaaaaacatatgcattgcgattttcaaaattagctaaagaattagccatgaaagctgatgaaaaaagaaaagcagaattattagaaattagccgtatttgtgctaaggttccctatgaaccagctcaaactttccatgaagcagttcaatcaacatggttcattcaattgattttgcaaattgaatctaatgggcactctttatcatatgggcgttttgatcagtatatttatccatattaccagcatgatattgatcatggacttattaatgatgaccaggtggtagaaatactaacaaatctatggatcaaaactttaacgatcaataaagtcagaagtcaggcgcatacattcagcagtgctggaagtccaatgtatcaaaatgtaacgatcggcgggcaaacaccagataaaaaagatgctactaacgcattatcatatctagttttaaagtcagtagctcaaacaagattaccacagccaaatttaacagtacgttatcatcgaaatatgccaaaagcatttttggatgaagctatcgaagttatgaagttaggtacaggaatgccggctttcaattcagatgaagttattattccttctttcatcgaaaaaggagttaaagaagaagatgcttataattatagtgcaatcggatgtgttgaaacggcagttcctggtaaatggggatatcgatgcaccggaatgagttatatgaactttcctagaatcttacttattactatgaatgatggaatcgatccaacatcaggtaagcgttttgtcaaaggtcagggacgttttgaggacatgaaatcatttgatgaattgatgaaagcgattgatcatgttcttagagagttaacgcggatgagtgttattgttgaaaatgctattgatttagcattagaaagagatgtaccagatgttttgtgttcagcgttgacagaagattgtattggtcgtggtaagacgattaaagaaggtggggcagtttatgattttatttcaggattacaagttggtatagccaatatggcagatagtctagcggcaataaaaaaacttgtttttgaagaaaagaaaataacgcctgtacaattaatggctgctttagctgacgattttacaagtgttgaaaaccaaagaattcaaaatatgttaattaatgatgctccaaaatatggaaatgacgatgattatgtggatcaattagttgttgaagtttataattcgtatattgatgaaatgaaaaaatatcctaatactagatatggtagaggaccaattggtggtatccgttatgcgggaacttcaagcatttcagcaaatgttggtcaaggatatggaacaatggcaactcctgatggaagaaaggcgcatacaccgcttgcagaagggtgctcgccagctcattcgatggataaaagcggcccaacagcagtttttaaatctgtttctaaattaccgacccatgaaataacaggtggggtattattgaatcaaaaagtaaccccacagatgttagctaaggaagaaaataaagaaaaattagaaatgatgatcaaaacattttttaatcgattagatggctatcatgtccaatataacgtcgtttcgcgtgatactttgatcgatgctcaaaaacatcctgaaaaacataaagatttaattgtacgtgtagcaggatattcagcttttttcaatgtattatctaaagctactcaagatgatattattggtagaactgaacaaatattatagtaggagaaaaaagagatggaatttattattgatacagtagatttagaagaaatcaaggatgctatagatcacatgccaattaccggagtaaccagcaatccttcgatcgttaaagcaacaagtcctaaaaacttctttgaacatatgaaagaagtaagaaagatcattggtaaggaaagaagtctccatgtccaggttatttctaaagagtgtgatgaaatagtcaaagaaggtcatcgtattttagaagaaatcgatgatcaggtatatattaaagtaccggtatcctatgaaggtatcaaagcgataaaaattttgaaaagtgaagggcataatgtaactgcaacagctgtatatgatttaatgcaggcatacatggcgctagcggcaaaagcagattatattgcgccatatgtaaatcgaatcgggaatttaggaagtgatccatatgaattgatcaatgagttatcaaaccgaattgttatggataattatgaatgtaagatcttagcagcaagttttaaaggcctccagcaagtacgcgatgcctttaatgcaggagctcagagtgtaacagcgccagtagccgtattgaaacaaatatttgcaaatccaaatattgaaaaagcggtaaatgattttaataatgactggtatgatgtttatggtaaaggcaaaggaatttgtgatttataggattaagacaaaagcttagattattgacaaagtagaatttaaaattcgtactttgtcttttttttgtttttttataaaatattaattttatttgttaggtaccttgatatttgtttgtgaataaatataatgtaatagataggagggtaaagtaatgaaagaagtaaaaaataaaaagaatcttgatataaatgatgatattattattaatttacgtgagataagccatattatgcactgtttatatgaaggtaagggaagccaaaaaagaattcttattgttttaaatgaaacaggtaaaattactcaacgtaaacttacaaagaagttaggaatccagcctggttcagctagtgaggtaataacaaagctggaaaataatgattgtataattaaaacagcaaatgaaacagatcatcgtactatcgatattgaattaacggaaaaaggaaaaaagttagcactagaagctaatagtcagcgtcataaaagacatgaagaaatgttttcttgtttatctgatgatgaaaaaaaagaattagtagcattgttaaaaaaagtaaatactgattggaaagagcgttatcatgatattaaaaagaaaaaatttcggccaaataaaaggctggatagtaataatggaggatagtttatgtggaaatatgtaaagaaatatttgcattttgctattgcagcaggtctttttatgattggtgaagtttcaatggatctaattcaaccaggaatcatgagcaagatcgtagatgaaggtgttttgggactaaaaaatagtggtataagtgatttaaacttgatttggcagttaggaatacaaatgatcggattagtattatttggtggattttgtggttctcttaataatatgtttgtccatttatcaggacaaaatattggtaacgaaattcgtaaagattgttttttcaagatcatgacattttcttttctacagatagataagtttcaaactggatctctagtaactagattaacaaatgatattacccaagtacaaaactttgtttctcaatttgtaagaggaatgattcggacatcgttgcttatgtttggaagcatgtattgtatgtttcgtttaaaccgtgattttggaataattgtaatatgtgcttttcctgtgattattggttgcttagcgttttgtttatttaaagctgatcctctttttttaaaactgcaagatcagcttgatagaattaatgtaattatgcaagaagatatatcgggcattcgtattattaaagcttgtgtacgggaaatttatgaaaaagttcgttttaaaaaagctaatgatgatttaattaagacccagctgcaggtacttataatttttgcgtttatgaatccgattattaatgcgttaatgtatgttgtagttgcagttattttattagttgggtcttttgaagttgctagtggaaaagttacaccaggaagcattatggcagctattacgtatactacccagttactcaatggaatcttgatgctcgttatgttgtttcaaaatatttcaagaggtcttgtatcatggaaacgggtaaaagaaattttatgcagtgaaccagaattaaagaatgggctatataatggtgaaggtaaaagagatggagaaatagaatttaaaaatgtttcttttgcttatcctggtaatggccagatcgttttagataatattaatttaacgattcataaaggggaaacggtagctattatgggatctactggatgtggaaagacaacactcgttaatttgatattgcgtttttatgatgttaaagaaggtgcggttttagtagatggaattgatgtacgcaaatatgatcaaattgaattacgaaaaaaggtttcgattgcttcacaaaaaagtgaattatttaatacaacgattgctaaaaatattgcttggggtgatcctggagcatcaccggaagccatcaaagaggcagctaagattgctcaagcagatgattttatttcatcatcatcagatggttatcatacagctgttttagaaaggggaatgagcttatcaggtggtcaaagacagcgaatatcgattgctcgagcggttttgaaatcgtcagaaattttaatttttgatgatgctacaagtgctttggatctaatgacagaagctaaattatataaagctttacagcaatcaaaaccagaagcgactaaaattattgttgctcaaagaattgcttctgtacgcaatgctgataggatcattattttagataatggaaaaattttagcgtgtggtaatcatgaagaattattgaaatcatgtactgcttatcaagatatttatcattctcaaattggaaaggaggatgtaaacaatggtaaatcgtaatatgccaggaacgaaccatcatcagcgttttgttgaagtgcagtatgcaaaaaatattaaaacaacagttaaacggattgctaaatattttatacatgaaaagttaatggtaatttgtatgttgatagtcgttatctttggaacgctttgtggaatatatgctcctagtttacaaagtaatgttattgatataattgctggtagtgtgacaggtaattttaataacatgctcttttttatgtttattgtttatatgttttatagcgggagccaattgttgcaaggttttttaagtgctaaaatcagtcagcgggttatcaaaagaatgagagaagaattgtttagtaagatcattgatttaccggtttattatctggatacaaattcttatggtgatataatgagtcgaatgactaatgatatagaaaatatttctacaacgatttcgcaatcattgccttcgctgttttctggggtattgacgatcattgggacggtaggaattatgttctggtattgctggcagcttgctttgcttagttgtgtaacggtcttattaactttgctggtgacaaaagttctttcaggaaaagttcgaaaattttcatgaaaaagacaggcgttacttggtaaacttaatgcgactgtagaagaaatgctttcaagctatcgtacagtagtagcttataatcatcaggatattacaactgcagatttttgtgatacttctgatctacttactaaagctgggataaaaactgatatttttagcggggtaatgggtcctgttatgaattgtattgggaatgttggttttgtgatcattgctgcatttggaggttatttttcagttaaaggattaatttcagtaggtgttatttcagcttttattgtttatgcaaaacaatttagtcgaccaatcaatgagattgctcaaatctatggtcagttacaaactgcgattgctagtgcagagcgtgtttttgatgtgttagatgaaataaatgaggataaatcaggagaagaatttattcaagataaaaaggcgacgattgtttttaaaaatgttaagttttcatatgataagaagaatccagttatttacgatttttcacttacggttccttcgggaaaaaaggttgctttagtaggagctacaggtagtggaaaaactacgatcgttaatcttttaatgagattttatgatattgatagtggagaaatttttattaatgatcagccaattaaaaatatttcaagaactagtttaagacaaaatattgctattgtactacaagatgctatcttgttttctaatactgttcgtgaaaatttgaaatatgggaataaagatgctactgagcaacagttggaaaatgcggtagaaatgagccggtgtaaagatatgcttcaaaaactgcctcaaggctatgagacgatattaactggttcaggcaaaaatattagtcaagggcaaaaacagttacttactattgctcgagcttttatcgctgatcctaaaattttgattttggatgaagcgacatctaatgttgatacccgtacagaaaaagcaatacaggatgctatgatggagataatgaagaatcgaacaagtatcattattgcccatcgtttatcaacgattcgtaatgctgatatgattgtagttatggataaaggaaaaattgtggaaagtggtgatcatgatactttgctggctcgaaaaggaaagtattatcagttgtatatgacacagtatgcgggatttacgatatagtatgattaagtgttttagtaattaaaacactttttattttgggatattaataaatgcaatttgttagttaaaaagtgtaagcgggatatatattaattgggataaattgaatgtataatatatttaataagaggtatttttacattaaatatttaattgattttatataataataggtaaattttataatttaaaagatatggtttttacgataaagtataaatatatgaggtcgaatcatcacttataaaattattatcgggggaagtgattttgtagggaaagatgttgccgatattaaagctaactgataaaaaaggagcgtgagaaaatgaagaaaaatctgttagttattaaaaaaatatttatagttgttttaactgtttttatggttttaatgggctgccctgaagtaaaagcaaatcaaatctattcagaaatgattattaatgattctgatgttggtgaagatgttaatcagttttggtttagtgatggctgggtgcatgagggtggctatcccagcttatttgaaggtggtgatgaacattggacaactaaagcggttttcaatgagaattatccatcatattcgttaaagtttttagggaatagggttacgttatatggtcatcgtgttaatgatggatgtatggcagatgtttatatcgatgatataaaagtaggggaaatcgattattatcgtaatggtagagcaaataaagaaatgttgtatcaaagttcattattagaaaatggtctacatacgattcgagttgtattaaatggtagtaagaatgtaaatgctggagataattatgaagcagcggttgattacgctgtagttgaaagtgaagagatggagtatttagctacagatatccagttaagtgatttacaattaagtttagaagaagggatgcaaaaacaaattacttatacgattcttccatcttatgcaacacaaatacctgatgttatttggacaagtgaggattctacggttgctgctgttgatcaaaatggtttaattacagcagttggtgctggggttacgaaaattacagcaaagctggaaaatacagatatttttaagcaggtagaagtaaccgtgaaaccttgcaaaaatgaaattatagggataattagtgataataataaacatgcatatccagaacaatatttatcatatattaacgatctttatgataaagatttagcgtctttacaaacgtggcgtaaagatgtttggaaaaatgatgaagtaacgagtcgaatcgatatttttacgaaagcgaaagaatatccggctgtatcattaatagccgatgatttagttgatcaagaagggaatgttatcagtaaagagaatattcatctaacttatatggatacggcaatagcgcatacatctaatcaacgtatctttgatattatctctcatgatacgcaaaggaatttagaggcaaatcaaatgtatagcgcatgggtggatataacgataccaaaagatgctaaagcgggatcatatactgcaacgatatcattagtatcgcaaggtgaaattttaacagaatttacatatcaacttgatgtcttggatctggtgttaccagaatttcaatcacagattgaattatggatgtatccatacagttcaaatcgttattattcagggaaatcatctagtgagtactttggcacagatgtaactgatttgtattatgttcatttagatgatcaatatcaggcaggattagagagtcaactggaactttataaaagaatcggtggggatgctattactgttacggtagtagaagatgcttggaatagtcaaactcatgatccttatccttcgatggtaaaatggacaaagagagctgatggaacatttagttttgattatactgatttagacaagtgggtcgaattatgcatgaaacatggtattgataaacaaatcaaggcattttcattatcgtgttggggaaatcgaattacttattttgatgaagcgacaaatcaagtgatttttgaaagaccggatactggttcgcagcgctggaatgaattgtggtcgatctttttacaagattatgttaaacatatggatgaaaaaggctggtttgatctagcgtatatgtcaatggatgaacgtcctcttagtgaagttactccagtcttagatttagttgaatcagtaaaaaataaagatggtaagtcattaaaaacttcacttgcagtatataattatgatactgaaagtatttttgacaggatcgatgatctatcgctttcaatatcgatcggttctcaagataaggcaaaagaaattacaaaacaaagatcacaacaaggtttaataaccacgatatatacatgtggagcacaaaatagtgctatgttaaataatcctggagagagtgtggcatctatttatgaaagttataaagatggtacagatggattattacgctgggcttttgattcttttaatgccgaaccgcttatcacttctcaacatgatttgtttgcagctggtgatttatacttgatttatcctgatttaagagatgcaaattataaggctcaatctacaccaaggtttgaaaaacttatagaaggtttaagggatattgaaaaacttcgctatttaaaagaaacatacagctggctaagtgctgatgttgaaaatgttattaataaattgagttatgatattacttcatcacaaaagcttattgatcaattatctaaacaggcagctaatggatcagtagttccttatatttcaattaacgagcgtgatattgaattatacccagatcaaacaaaacagttaacggttacagtatcacctgaaaacttattaacagagattttaaaacaaacagcaattataaatgatttcgatgaaaatgttgtttataagggaatttggtatactgatgaaggatatccaagtatgttttataatggtgatgatcactggtgttcaccagttgatggagatgatgctaaaaactatggctatgaatttgatttttacggagatagttttgcggttattggaaatttagaatatttaaatgggaaatttgatgtatttattgatggtgaatatgtaacaacagtagatgcttatagttcgggaagaattgtatattctcgcttatatgaaagtgagcgtttggaattaaaaaatcatcatgttgtaatcaaaggtagtggtacaaaaaatgctatatctactggatataatatgcagctagattatattgaaacttatattcatgaaaaattagtatggcaaagtagtgatgatcatattgttacagtagaagatggtgtgattacagctcataaaacaggtatggctgatattacagttagtggtggtgaatataatgatactattcatgttaatgtaaaagtggatcctgctactattgatcttagtgagcttgaaaaaataattgaagatgctaaaatgattgatttgaacgcatatcaagagataggaaaatctgagtttgagatggcattagaaaatgctgaaaacattctaattgatccaattgatcaagcaacagtagatatggcggtaaatacattagctaatgctatcaggaatttaattaaaattgttgaaaatcctgaacaaccaattgaaccggataagttagatgatacaaatatatctaaatcaccacagactggagatttttcaaaagaattaatttatggatatttcatggtagtttgtacaataatcatatatgtgtgcaaaagaaaataagatgttttaacgaaaaggggctgtaacgaatgaatagtttttgactattcattcgcttttttatgtcccgtttttaatttctcctcattcataacaaaaaaatatccaaatatttatttacttggatacttttaggtatttttgacgcacttaaaaagaactagctttctttttttttaaaatttctagcttattgattttttttcttcgtattctttgtttttttgtttatatctgtgatatttcctcagattatgtcctattccgactaacagtatctcttcttttacaccattttctcccctccgtcgtaatcttccatatccctgatttgtttttatatcaccaaatgttccttctgtttcactgcttctcttatttattagtttttttccttcttcgctttccagattctctctgacctctttttgatattcctctaactggtagttatgattaattgttcgtcctgattttgattttgtacatctgcttcttagtggacacccttcacagtttttatttctaaacagaaaatttaatttctcataatcacttcgttcatcaattgtaattttttctaattcaaattcatgtcctgccggacatatgaatcctccttcttctgtccttttcatatggttttttttaaatctgtttttatcatttgttttttctttctctttgtaatatccactatatttcatatacaactcgatattatgttctttacagtatgcataattttcataacttccgtatcctgcatcagccggtgttttcttaggataacatccatatgcttcatgatatttttccataaatggtatatatgtatttatatcattaccatcactgctgatataaatatttctaattattccatcgctcacgcctatttggatattatatcccggtttaaatacatttgtatgattataataatcatatttcatatgcataaaggttgcatcaggatctgtcttagaaaaactgttcctttctcccagaatgtccatatgaattgtatattcaaacatcttcatcgcgtgttcttttaattcatcatataatttttgaatatcacttcttcttttgcccctgccatgtacaaaatcaatatcttcatctttcatgtattcttctatcctatcactgattgttattcggtggattattttaattaaaataacagctatttagtcaaataaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccatgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcactgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacacactgatattcaataaataatcgatacttggctcttttagtaatgaatatcttagattgatattatttttcttaaaatatctattgattctgtcaatacactgattagtctttttccagcgtttagttctgtttctgatcgtattagcacgccaaacaaaagtatttttattagcattggcttcatatttagtcccgtcgatacataggacatcagtattgatattcatcttttttacaatatacctgttgatttcataaaaaatatcatcgatagacatctttaaatcatcattgatgaatctttggaaagccatatggctgggacactgattcttagcgataaacatatatctaatatcagttttacaaagacgttcaaggcgtctggtagaagcatagccgtattcagctttagcaagcagaactaaaacgaacatcataaaggaatcataaccatgggtatttctgtgagagaagtcgacatacttatttatatttacctcccgagcgacttctaaaacagttctacaaatatcatcatggggaacatctttttcaaaagaaaaagaaaaatccagtagcaaataagattgaaatgagttataatttgaagtgttaatattaatatttgacatgaaaatattataccaaaaaaacgctcgcttgagcgctttttttgttttatgaagctgtaaaataattatttactcgttacagcccctttcaatcagtgtttttataaaaagtcttggcaagaaacaagaagatctatttttttccattgagtatcttcatcaatgcagtttccttcttctacagaggcaaaaccacattgaggagatagagcaatattatcaccgacaattgatttggcttcaagatatcttgccttgatttcatcgtgtgattctaaaacaggatttttagtagatatcaaaccaactacaaaagtggcatttgttccttttaactgtgcccatggatcaaaagaaccagaacgctcatcatcatattctacgaaaaaaccatcatatggaatttgacaaatgattggtgctactgaatcataaaagcctttaaagagaggataacctttaaaattccctttgcaaaaatgacttgcaataaccatatcttgaggtttgttttctaaagcttttgtagaaacttttttaaaccactgcaagatttcatttttttgatagcctaatttatcaacttttgctaaaaaatcatcgtcaataagatatgtccaggaagtatcatcgatttgcaaatagcgacagccatggtcatatagatctaaaatagcatcttgataagctgtagcgatatcatcgataatggcatcgatatcattgccataataaggggtatcttttattcctaattgtaagaaatgatcaactaaaatcatattaggaccagagatacattttttagcttcaataccagggtatttttgagctaagttataaagaaaatcccaggcttcaatttcagggtgtgatttatttttatcataagatatttttccttcaatcaaacctaattcaatatggtttacaacaccgtttctttctttatcaaggtgtttggttgtaaagccatcaaattcttttagccagtctaaatgccaccagcgacgtctaaattctccatctgttacgtattttaatccatgagcaacttctttttctactagttttgtgatttcttgatcttctatttttcttagttgttttaaatcaatttcatttttttgatattgagcacgtgcttctttaatttcttgaggtcttaaaaaagaaccaacgatgtcatattttatatttaacatgtacttatcctcctattattgcatataataacttgtcttttaattattgtaaaatacagaaaaatagcactttgttatagttattagctataatgagattaaaatatcttatttatagaaaaacatctaaattttatttataattataaatatatatttttatttaataaattaaatataaggaggttatgttgttttaattcaactatataaaatgaaaaatattgaacaaattgttaaccaacagcatgaatattttaaaactttaaaaacatacgattttagtttcagaaatcaacaattgacattactttatcaaaagataaaagaatatcaaaaagatattgagcaggctttatatcaagatttacggaaaagctcttttgaagcttattcaaccgagatcggttatgttttaaaaagcattagacatatgcagaagaatttaaaaaagtggatgaaaccaaaccgaaaaacagcaccatattatttatttggttcatatgatacagttacttatcaacctttagggataagtttgattataggacccttcaattatccttttcaactcgtaattgaaccattggttggtgcaattgctgctggaaattgcgcaatcgttaagccctcagaaaacgctcctgccacagctaaaatagtaaaaagaattattgacgaaatatttgtagataaatatatttgttgtattttaggagatgcatcaataacgattaagttaactcatagtttggttgatcatattttttttacagggagtattgaagttggtaaaaagataatgaaagcagctagtgaacaattaataccagttactttagaattaggaggaaagagtcctgttataatagaagatagtgctttattaaaggatgctgttgaaaaggttgcctggggaaagattttgaatgcgggacaaacttgtgttgctcctgattatttaataattagtgaaaaattaaaagatgagtttattcaaatgtggcaaactgtaattgagaaatttttaagtcaagatgattatgctagaatagttaatgagcgacattttgatcgtttagttaatctttttgataatgaaaaaatatataccgggggtaattatgatcgtgatgatctatggatcgaaccaactttagttagtggaaatgatagtagttttatggatgaagaaatttttggtcctattttaccaatcatcacatataaagatcgtgatgaaatcgtagaaattatcgaacgccatccgtttcctttagcgctatatattttttctaatgataaacaatatattcaatatttaacaaaacgactatcctttggcggtggttgtataaatgactgtataagtcatttagtatcagctaaggtaccatttgggggcgttcgctattcgggaatgggacagtatcatggtaaagatagttttattgcttttagtcataagcagacgattcatcatcgttttttgaaaagaaactttatctcattatatccaccatattcaaagtatttatataaattggtagaaaaagtattaaagtagtgatggaagtttttaataataataatttttgaaattaaattgtattagtgtttggtttgggcattatttaatggtttaaagcatatatttagataggtgattttgtgaaaaaaacatatctaataattgcaataactgctgctatatatatatttactaaatgtttttatctaagtagtccagtagctgtcagtaaagaactaacattagaaggggtatcggtggtaatagatcctggacatggcggtcttgataatggtgctagtgtgggaaaaatatatgaatcagaattgaatttaaaaatatcatttgcattaaaagaagaattggaaaatcgaggtgctaaagtgtatatgacacgagaagatgaccaagatatgacaaaacgtaattataattattctaagcaggatgatatgtatttacgggtaaaaaagattgattcatataagagtgattatctgataagtattcatttaaactcagcaccaacttcaagtgcatggggatcacaagtgttttattataaaaatagtgaaaaaggtaaacgtctagcaagtgaaattcaagcggcaatggtggaagtgacaggaagtcctaagcgaatatccggtgccagttttagggtattgagagcaacccaaacattaggggtgctgattgaatgtggatttatatctaatgctaatgaacgagggcagcttcaaagttctaagtatcatcaaaagctggcagtaaaaatttgtgatggtctagaaaaatatcgggaaaagtatcctgaagatacaattaatgaagaggattatgaaaaaatattaaattaatactttttataaatgatatagatttagataatataaaaatagttgagatcattaaggggttcttactcgcttatgggtaaatgaacttattagacagcacaagaaattgtgctgtttttgtgttctaaaatatcaattagcttaaaatctttattattcattaaaaatggtatgtaacatttcctaaaaagattgactattttgcttcttccatataaaatacgtttgatgagtttgaatttgttgttgtttccttcaacaaatcccgaactatatggataagatattgcgttcttgatcggggcaatatctttttctataccttctataaatccttttaatactgattctctataattatcaataaacttatctagctgatcagtatctgcctccttgatcgtgctgtaaaacgaatcatatattttttctagttcagttataattggatatctttccttgattatttgaatgtttttttcaactgttttatttttctttgttttctcatttttagttgttatgtattttaatatttcatttctttttatgatgatgatattatctggatatttatacttaatataccaccccattgaaagagaaatactaaaattattttttaataagtatacaattctgttatccaatgacttccacgtacctttatatcctttcataatgacatagctaaagattatttctggctttattccatccaggatcattttatagatcatattgatatagtcatctgtagctgtttttctttgtttgtatttctttggactgtccaacaattgaatatcctcttcactcatatttacatattttttagctacaatatttgatattgaaaattctttagctattgttgtgtatttctttttttcgagttcctcccatcttttttgaatgtcaatgatcattttctgtttttttacggctttcagcctgctgtctgtgttgtttatcgtttttatcataacataccgcatcaaaatcaatcatatttccttctttatcaactggcatactgttgtcatagtcatatttttcaagttcctttgaatttggatcgatttttaatgctggaaccttttgaggttcctcttccagtacctttccatcttttatgaatactgtttccggtatttccgttttaaaaatatcttttattctgtcaattaaattttgaagaagatgaaatctgtctgcaatctggatacattcaggtaaaacttcactgattgcagaagcgtatgcacttgctctgtcacgtgtggcaatctttattttttgatgattttttagccattcaacaactgtttccttatctcttccatctaaaagcgcaataagatgatgatcttccatatcatatatggcagttgcataagcctttccttttctcatcgccacatcatctattccaatagactcgacatcagggtcatcttcaataatgatcttatcagtcaggcgtttgatagagtcattgcttatattgaccccaagaagtttcagtactttactggcaccttcattgcttaaaaagagagaaactgcaaggataagacagttaagctcatctgttcttctttgagagggagaaacaaaaggaagattctgcataataacctttctattgcatttgtcattagtacagtcatatttataagcaattacattaataaaagttgttttatttctaacaggataagcctgaatcattctatgataggtattatgtaaagaacttgtaggagaaccacatacaggacatacatcatcatgagaagtcgctttcacatatattatgattttattatctgattctttccagtcatagacaatgaagtcattaccaaagattttttcattcaaactgatttcattatatttcatatgtatcaccatccatacatatattgtatcaaaatgcccaaaaacaagaaatacaaactaaagaaaaacagcacaatttcttgtgctgtctaataagttcatttacccataagcgagtaagaacccattaaggaatcttaactatttttgtttgataaaatatatgcagttgtagcataaaaaaataatcttaaagatactacatcatatagtatctttaagaaattaatgattattatatctataattatagaattgatacataataattagtacatatataagggctataacgttaagaaagttatagtttagatgaattaaaatactattaatgaatggatcgatataattgacaagaattattcctagaattccccacatcaaactataaaacatacaaattctaccagaataattatgagaaattttagaatagttccagatctggatatttgaatcttttgataagaaataatgtgtcagatattctaatgcagtacaacaaattagagaataaaaaaatgtgtcgaaattattttgataatagggaacggtctttaaaatcaatagtgctccaaaaccgtatataggaatgaaaggtccttttaataaccctgaaaaatatatcttacgttctaaaatagatacatatatagattccataataaaacctaaaaaagtgtatatagcaaattttaccattattacctcctgtaatataattatgaaaaaaaataaaaaatatgcaaaattgtattaaaactttatattgcgataataaaggagtaaaaagagtttatatttttgtcaaaaaatataattaaactattgacgattaaaaatatgtgtgttattatatcttggcagtcgattgatgggcctgtagctcagttggttagagcgcacccctgataagggtgaggtcgatggttcaaatccattcaggcccaccattaattaattgcaataatatatgggcctgtagctcagttggttagagcgcacccctgataagggtgaggtcgatggttcaaatccattcaggcccaccatatatatttatagttaattggggccttagctcagctgggagagcacctgccttgcacgcagggggtcagcggttcgatcccgctaggctccaccaatttgaatatttagtctgcttaggcaggctttttaattattttaaggagaaaaatatgatgaatcatgtaataattttgattgtatctttttatatatatagctttatgggttgggtttgggaatctattattttgccactagcaagaaaagaagtgccttataatagaggttttttaaatggcccatggataccgatttatggttttggagcaatgttagtaattattttgtttgatatacatcaaattagttacccaattcatgttttatttttaagtagtggtgtcgttgcttgtttactggaatatcttacttcatttgttatggaaaagttatttcatcgacgctggtgggattatagtcaaaaggcatttaatataaatggacgagtttgtttagagggatttctttgttttggtttatttagtgttgtggcgataaattatattcagcctttttttactaaagagttgttaaaagttaatgaaaatatattatttattattagcggtattttaacgatcggctttatctttgatacgatcatatctacgcacattgctttagatatagagaagaagctggatcttgtaaaacagattttagaagagcgggaagaaaaaattattgctgaattagaaagaggacatgctaaaactttagaaaaattagagaaaaaaggtcttgaatggcgaaaacaacaattgttattaaaaacattattgaaaaaggagaaattgtttaaatatcgtcatcggcgtttgattagagcgttcccacaaataatcaaaaagaagcggagtgatgattagtgttgaaaaaatattttgggacaaaacaattttataaagaagtaacgacgattgcacttccgataatgggacagcagtttattactacttttgttaatttgattgataatgttatgattggtagtgttggtaatattgcgttaacttctgtaacggtagcgaatcgtttctttttgattatgaattcaattttatttgggttatgtggtgctgcaggaatttatattgctcaattttatggtgcaaagaaaaaggataaatgtcaggaagtttttaatataaatatggttttttcgcttggggcggctatatttttttctttattattatttgtagttcctaagtttgcgatccagcttttttcacaaacaccagtaattgttgaagaagccgttgcttatcttaagattgcaaaatttacgtatgttccttttggaatctcttttacttgtatgatggcgttaagagcagttggaatcaataaaattcaattaaaagtagggactgttgcggtacttacaaatacattattaaattattgtttgatttttgggcattttggattgcctaaaatgggaattcaaggggcagctattgcaacattgattgcaagattagtagaaatgaccatttatttaatagtgttgataaagaaacgacatttctttaaatttgatttaaatggattattgcatattaatacggatttgcttgttaatattgttcataaagctattccgttgactttaaatgaaattttattttctgttggacaggcaatggtttttaaatcatatattagatgtgatgaatatttagttgcttctatatctgtcgtagatacagtttctaatattatgtttattgcttttgggggattatcttcagctgtgtcgattatgattggaaataaattaggtgctgatcaactcgatgaagctaaggataatgctagaaaattattgtgtttttctctaatggtttctttggtagttggaacctgctgttttttggcagcgccttttgtaccaaatttatataatgtagatgtttcgataaaggaaacgatcgtagccttgcttagaataaagtcgataataattaatgtatatgcttttaatgtgtgtatcttctttatattgagggctggtggtgatgctttaagcacaatgatcatggatagtggttttttatggctggtaaatgtattggtttcaacgttgttatcaatgtttacggagctgccattagtcactttgtatatgatcgtggaaagtttagattttattaaattaataattgcgatatattttttgaaaaaagagcgttgggtcaaaaatattgtagtagtaggagagtagaatgaaaaaagaaaattattttattaaaacgcttaatggaatggcatatggctttttttgcagtttgataattggaacgattttaaaacagttaggaagttttacgcaaattaatgagctaactgcatgggggcaaacagcaacgtatctgatgggaccggcaattggtgtaggaattggttgtgcggtggacgctaaaggattaaatctgattgcggctattattgcaggaagtattggtgcaggaacttttaatggcagtgcagcgacgacaggtaatcctatagcgtcgtatgttgcggtaattggtgcaatcgaaataactcgttttgttcaaggaaaaacaccgatagatattttactggtaccttttactgcgattattgtagccgggataattacaattattgttggaccatatttaacgaaattgattttaggaattggtgatttgattaaccaaggtgtaaatatgcagccaattttaatgtcaattgtagttgcagttttgatgggaatggctttaacggcaccaatttctagtgcagcaattggggtgatgctgggattaaatggtttggcggctggtgctgctttggcaggatgttgtgctcaaatgattggttttgcgatgatatcaatagaggataatgatattggagaagtgattgcaattgcgattggaacgagtatgctgcagtttaaaaatattgttcaaaaaccaattatttggattccaccaattattgctagtatcattattgctccgatatcgacttgtgtattaaatatctcatgcacaccagttggttctggaatgggaatggctgggttagttggaatattagaagcgattaatgtaatgggaagtagttattggattccggttattgttattgatataattgcaccagcttttatttcttggactagttataaaatgttaaagaaatgtgctttgataaagagcggagatttgaaattgaaacagttttaattgaatataaaaaagaagcagcatataacgttgcttcttttgtgttaatcagttgaaaataacgcaataatatcatttgtagacattttagtgatactgccgttattgttttcgataaagatattagataaatcttgtttttgttcttgaagtttttgaattttttcttcaatactatttttcataattaatttatatacttgaacattatttgtttgaccaatgcgataagcgcgatcagtcgcctgattttgagccgacatgttccaccatgggtcatagtggataacgatagaggctgcggtaagatttagacctgtaccgccggcttttaaagaaatcaaaaatacattagtgttatcgttttggaaggcgttaactaattgatgtcgtttgatcttatttgttgctcctgttaaaacataataagaaatatcttcgttacgaagttctttttcaattaaatctaatgaagttgtaaaagaagaaaataatagaactttttgattattctctttagcttttttgatgatatccaggcatgctttcattttagaactaggttcttggatttctttatacaatattctaggttcacaacataattgtcgtaatcgtgtcatcattgataaaatttgaattttatcaacgtgttcaatatctaaggcggtttttaatttgctgtttatttgacttagattagcgatatataagttttcttcttctttagaaaaagcgattttgatattgttttcaattttgtctggtaattcatctaatacatcttgtttagttcttctgagaataaatggttcaaccatcttttttaaacgcagttggatttctttgtcttcattttgaataattggtcgttcaaaatgttctttaaaataattataactaaataaatagttgggcattaagaaatcaaatattgaccatagttcagccaaagaattttcaattggtgtaccagttagtgcaaaacgatgtataccgtttagttctttaacggctttagcattttttgttgcttgatttttaatgtattgtgcttcatctagaataatatattcaaaataatgatctttatataaattaaaatctcttcttaaataatcgtaagaagtaattataacatcataatcattgatttgttcgattaattttttacgtataggtaaagttccagtaatgcataaaacttttagatcattagaaaattttttgatttcatcttgccaatttagaattaatgtggcaggagtaatgacaatactaactttatcatttgttctagtgttttctaaaacagtgatcatttgaagcgttttacctaatcccatatcatcagccaagattccgccaaatccgtaatcgctcatagttcttatccatttatagccttcgcattgatattcccttaggatgttttgatacgattgggggataagatagttgttattattacaatgagtcaatttatcgattaattctttgaactgtgtacttcgttcaaagttaatggaatctcgatctaaggataattggtttaagaacagtgctttagatttatcgattaagatagagccatcctgaatattattttcattaagatttaagtcttggattaggctatatgcttcgcttaagcttttatcttctagatttatgaaatcaccattttttaggcggtgatatgatttttttctttgaatagaatgaagaatttcttggatttcatcttttgaaacattaatactgtttaagtctatttctagtaaatcgtttttcaatcgaatacctatattcaaagagatatttttaggtttgttgatatttttgatatcttcgcttacgaatacttcacagtattgatttaatttagggagaatattttttataaaataataaacatcttcatcattatttgtgattagatacattttagttaattcatcataatttgcataattttcaatcaacactaaagctttatcaacatttaatggaagtttggtttcataactgtcgatatatttaccgtcaaataaaatatttccattttcatcacgatattctaaattgatagttagatcgccaaaattatttaaatcaatatacgctaataaagtaattacacttggcatatagtcatcgatatttgctcctgtaatagaaatatatggtaatatctgatcgataatatattttccaaagtatccaaaatcttccttagatacaattaaattttctttatccagcttagataagagatttttagttatttgtgacatttctaaactataacgatttaaaatattatcttttaaataataaatatattgatttccaagaattaattgcccttctaaaggaacaagtgagatttcaaaataatcttccttgtcttcgatattaatagtaagattttttaaatcgatagttgtaaataatatatttatgtttaaatttgttaaatatgtttcaaagaaatcgtctatattatatttattaatatcgattgaacgatagcgttcgatctcatcaataaattcactattatctttaataaaatctatttgttttaaagcttcttgactaaatgatttacgattatgatcagtaattaatttactgccatatgtaaagattttatgatagcggtaattatttataaattcttttaagtttttaattaagtaagttttagtgtttccgatacggtaattgattaaaattcgattaaatgaataatttatatttggaaaaagttctattaaagcatcgttggttatgcttatttcttttttatctacatatttttcaataagtttttttgattcttcaatttttgtttgaatcattttttcttcacgaatgcgttcaaattcttcgaattttgcacgataatcaattttttgattaaattggaatgggatatctgacatttctagactgtaaaactttagtaacagtactccaatatgaccacaggctaattcgtttgggtggcaattatgacagctgcactcaaaagtaacgatttttccacttgtatcaacgataatatgactagtactgacgcgaccatatatttctacagtaccatcaatatgatattcattaccttgctttaaaacagacatgttagtaatcacattgtctttgtagtagttatgagcagttttccagtttttttcattaaatattctatttatctcatcatcttttatatacatgttctttccctccaatgatttattatatcatcaatttaatgattaccaaatagaaattgtttaagaaaataattatttattattttagagaataatgctataatatttacagatgccggtatagctctaatggtagagcaatccactcgtaatggataggttgctggttcaaatccagttgccggcaccagttaaatgataaaaactacctgattaggtagtttttatatggtcaaagtatattttacaaagataaaattagtttttttatatataaaaagatgaattataattcatctcaatttgttgaatggtgacccgcaggcgattcgaacgcctgaccctctgattaaaagtcagatgctctaccggctgagctagcgggtcgtatttagcagtgccatataaaaatagcatatttttagaatgttgtaaagcgattttttaaataatttgctataaatatagaatactgttataatttagttatgaatggagggaaaaaatgaaaaaatcactcaaattattgatgatatttgtcattgctttagcgttaacgggatgtgttaaagttcgttgtcaaatcaatattactgatagggatgatgctgatattattatggctgttctttttgataaagaaatactagatacatatcagatgagtcaggataatattaaaagtcaattacaagaagaaggaaattttaaaaactgggaaattaaagatgctagtgagacgattgatggaaaaaagtatttaggatttagtgcaacagcaccaaaagaagtttctgaaaaaatattggaagatttaacagttgaagaaaatcaatatactttaaaattaaaaggttcagatttagataaaactataaatactaacgaatttgagcagttaggatattctactgataaattagaagaaatgggagtggaatttagcattaaaatttctatgcctggaaaaattaaaagttctacacttggggaagttaaagatggtgtagtgatgattggtttaaaagattatgaacagttatcagatggtgttgaaattgtttcagaaacatcagaaccttctagtaatacgggattaattgttggtgttatagcaatagtgatcgttggagcaggtgctttctatttttataagagaaaaagtaaatctaataaagataatttggaataaattttaagataaaaggttcgaaggtataaattttcgagccttttaaaataggatttttttatattatgagtatatacttttctacataattttaatttgaataatgctttaataaaataaaaaaggatatttaaagtgtgaaaaataattgaacccaatcgtgagtaaaaacacaaaaaaagacgaacttaaaaacaagttcagttttatttagaaaaaacagaatattatttaggaatatcttgaattgttgatacatcaaatccctgtgattttagaaaatcaagtgctgtctcaactgtataattgttcttttctttttgtggctttggattcttaaatgattcatagtctgaaggattgaacttttctccagtaagaatcatatgataaatactgacaagcatcatccttgcaatagctatgattgctttcttgtgtcctcttcttttcttgatttttgtatatttttgaccaaaataactgtttttgtttttgatagctgccaatgcacattgtactaatactggtttaagatattgtccagctttgttgatacgaactgatttcttctttcctgcactttcattattggcaggagaaagtccagcccagcagcatagttgcttatctgtttcaaattgagtcatatcaacgccaatttcagaaatgataagaatggcagacataagctgtattccatctatttctgtaatatgtaaaaaatcatcaaagtatctggaagcacgtttgatgatttctacttcaacagcttcaatatgttgattaagttcattcatatgtgattgaatttctgccattttaaatctttgatctggctcaatttttgaacttttaagagattcaactattttatctttgtttttgcacttaccatgaataagttttgtgattttatcttcatcaataacttcagtagatagaacttcattcatgacggcctgggctgtttttccaaaagtatcagaaacaacagaagccaaaccaatattggaaacagtcatggagttctgataacggttacgttcactagttctcatacagatgagcttaaaacgataacgagagagatcccttaattcacgaatatccttaggcgggataaaagaagatttgagaagatcatgcttgaaaagatcacaaatccatttggaatctttcttgtctgttttcttgcccttgatagctttgacatatttaggatggacaagaacaatattcattttagcttcagtctcaaggacattaaagacagggaaccaatacttaccagtggattccatgcagacatcaaaacattcgtgttcaataagccagtttttaagattatagaggtcaaagttaagagaagagaaatctttctgaatatattcagtgacatgagttttcttgtcagtgataccaatggtagcgacgataaggttcttgtgaacatcaagaccagcacaattaaaacggtggattttaagcataaaaaaactcctttcaaaaaaggagaagtggcattgactgtcagtctgcaaaatatcactatagttgataaaaacaatcttaagtgtccaggctctaagtcctacttgtttgtgcttgaaagactgacggcgacttataattattcaggatattctatatagagtagaattgcctactctcctccacgtgctctgtagtataccacctctcttataggatactacaaaaacgattggatgagaattatttttaataaaatgtttgtgtctgaccgacgaaggcggacggaaatggagggaagtgtgaaaaataattgaacccaatcgtgagtaaaaacacaaaaaaagacgaacttaaaaacaagttcagttttatttagaaaaaacagaatattatttaggaatatcttgaattgttgatacatcaaatccctgtgattttagaaaatcaagtgctgtctcaactgtataattgttcttttctttttgtggctttggattcttaaatgattcatagtctgaaggattgaacttttctccagtaagaatcatatgataaatactgacaagcatcatccttgcaatagctatgattgctttcttgtgtcctcttcttttcttgatttttgtatatttttgaccaaaataactgtttttgtttttgatagctgccaatgcacattgtactaatactggtttaagatattgtccagctttgttgatacgaactgatttcttctttcctgcactttcattattggcaggagaaagtccagcccagcagcatagttgcttatctgtttcaaattgagtcatatcaacgccaatttcagaaatgataagaatggcagacataagctgtattccatctatttctgtaatatgtaaaaaatcatcaaagtatctggaagcacgtttgatgatttctacttcaacagcttcaatatgttgattaagttcattcatatgtgattgaatttctgccattttaaatctttgatctggctcaatttttgaacttttaagagattcaactattttatctttgtttttgcacttaccatgaataagttttgtgattttatcttcatcaataacttcagtagatagaacttcattcatgacggcctgggctgtttttccaaaagtatcagaaacaacagaagccaaaccaatattggaaacagtcatggagttctgataacggttacgttcactagttctcatacagatgagcttaaaacgataacgagagagatcccttaattcacgaatatccttaggcgggataaaagaagatttgagaagatcatgcttgaaaagatcacaaatccatttggaatctttcttgtctgttttcttgcccttgatagctttgacatatttaggatggacaagaacaatattcattttagcttcagtctcaaggacattaaagacagggaaccaatacttaccagtggattccatgcagacatcaaaacattcgtgttcaataagccagtttttaagattatagaggtcaaagttaagagaagagaaatctttctgaatatattcagtgacatgagttttcttgtcagtgataccaatggtagcgacgataaggttcttgtgaacatcaagaccagcacaattaaaacggtggattttaagcataaaaaaactcctttcaaaaaaggagaagtggcattgactgtcagtctgcaaaatatcactatagttgataaaaacaatcttaagtgtccaggctctaagtcctacttgtttgtgcttgaaagactgacggcgacttataattattcaggatattctatatagagtagaattgcctactctcctccacgtgctctgtagtataccacctctcttataggatactacaaaaacgattggatgagaattatttttaataaaatgtttgtgtctgaccgacgaaggcggacggaaatggagggaattatgaaaaacaaatggttaagtataatgattgggatgataatgcttgtagggtgtgttaaacaagatactgaaaatatggtttcgatatctaagattgatataactgagcttaatgcacaaagaaaagttagtaaaaatgtaattgattttgaagatgatcaacaaggtaaatatgatttgttgaagctgatgattaatagtgttgattattataatttggtaagtggaaaaatgtgtgttacttcatcatatttagataatcaaacacaaataaaatatgagtttcaaattaatataccagaatatcgatcttttgtttatcaaatatcttcaagtggatatagtgaacaggtaatgtttagagatagtaagaatatgtatttttttactggtaacagagaggacctggataattttagttttgaagaattaattaataaaaaagaaatcagtattgaagaaatagataaagatgataatttattcaagtttgcaaaatggtctttagaagagcgatttaatgatatcaatatatcacgagttgctaatgatttatatggtgatgtagcaccgtatttgttgcctgaggatatagcgttgagacaattaggggttagtttagaaaattttaatattaaagaaaaaaataattttttgaaaagagaggtgttttttgtagaaggtaaaataaaaaatgatttgtatgttgaaggaggaaccgtatctttattggtggacaaagaaacaggaatagttttaaagtatgttcgtagtagtaataatagtcgagtagaaatgaaaatggaaagtatttcaatagacggtgatcgtgaagaagacttatatgaaaaatatattaaaagtagttaagaaaattgtatagattgacatgtcaatctgtacaattctttaaagcagtttcattttataatacctagcacagaaaaaaataaaaaaatgtaaaaaaagtattgcatataatttacataaatgatattatattagggcaccaagttgcttgaatagctcagttggtagagcaatcggctgttaaccgatcggtcgtaggttcgagtcctacttcaagcgccatggcctgttggagaaacggttaactcacatgcctttcacgcatgcattcacgggttcgaatcccgtacaggtcaccattttggaggtttagctcagttgggagagcatctgccttacaagcagagggtcagcggttcgagcccgttaacctccaccattaatattataagccggcttagctcaattggtagagcaactgacttgtaatcagtaggttgagggttcaagtcctttagccggcaccattttatatgcgggtgtggcggaactggcagacgcactagacttaggatctagcgccttcggcgtgcaggttcgattcctgtcacccgcaccatttagatattaaaagtatatgcggaagcgatgggtattgatctcatcgcttttttgcatttttataaaaaagaaagtattattatagtgattaaattcaagattagtcagataactaggaatttataagaaataatagaatctatgtatagtataaatattaaagattaaaagtataacttttgatatagacgataagaattgacaaatataaagatgcttattagaataattatataagttaaatattttacttaaattatggtacggtaatgattatttatatgagaaaggattgggaaaatgaaaaaagtattgaaaagtgttttagcagtctgtatttcatttgttatgttgttttctgtgacatcaaatatttcagcagcgaatactgtaacagttgctgaacaagatttgataagccaaattttaacatactactataaatatacagaaggtgattttaattcagataatggatggtcagcctctgctattaatgctgatattgatatcgaaagatgtttatcagaattaaaagaattaaatccaaatttgggacaggcatacagtaatattattgaacgctggatatatgctgatacaacaatgccaattaacaaagatgtattacctgatggattaccaaacgataatagtttatgtattgtaactttaggatttcaattaaatcaggaaacaggtgaaatgcagccagaattgattgatcgtttaaatgttacattggcaagtgctcaaaaatatcctaatgcatatattgctgtaacaggtggtggaacttctcctgctgatccaactaaaacagagggggaagaaatggcggcctggttaattgaacatggtgttgatgaaaatcgtatcattgttgaaaatagagctccaaccactgttggtaatgctactaatacatttgcattattaaaagaaagaccagaagtaaaatcaattgcaatgatttcatcagcttctcatattcaaagagctgttgcaatttttgaaacagttttccaattagaagcatataaaactaatagtgaggcaattactattttagataatgctagttgtcctgttagtagacaagagtcattggctcaacaagttgctgcagttgctcaagcaaccgagttttgtttgaattcaagtattgaattatcagattcaattcaattatcaaatcttgatagccttgaattaagtattaatgaagaatatgttcaaggtgctaaagttgaaccaaaagttgtagcaagttttacaactgctgatggtaaacaattccaaagtgatgttactaaaaatgctgtgattgaaggaattgatacaaataaattaggaagacaaacgataaaagctgaatatagttacaataatgtaactaaagaggtggctaaagatataactattaaagctgttgttgatacaactgtagattcgttaccagagaaaacaccatcagtagcgactggtgatgatatgataatgagtggatttgttagtttaatgatgttaactgctggtggttatgtatatttaaaaagaaaagaaagttaattttgatgagtttaataataccgtactaaagtaaaagtttaatttaagagaatacagaaataggattgataattatcaatcctatctttttgtttatttattaaaataatagatgaaaatgaattgttttaaatagtaattaaatgtttaaaaattaatattttttcaataataattaagacaattgaatagatttgatctaaaaatggattttattgaagaaaatttaagtaagagattgaaatattttttcataaatataatattttggatcaccttttcgatatataaaataaagtgggtgttgcaactgataatcttttattttaacatgtgctaattttccgttacttaattccttttttaccactccttcatataaaaaagttacggctgatgattgtgaaattaatttttttattaataaaatactcccaatttcaataactgtttgaaatgattgtggactgacgtttctttgagataaccaattttcaagaatttctcttgttcctgaatctggttctcttaaaataaggggataatcttgtagttgttgtagtgtaacttctttgttggaaagcggatgagtagaggcaacaacgggaataaatgattcgtttttatatagttttgtttcaaagaaagctgtatcaaatattccctcaacgaatgcacagtcaatatcgccattttgtaatttttttaaaagatttgttgtgttttcaactgtgatacgtatacgatctttatctgttaataagttttttattagaaattgcggcaagtaataatctgcaattgataaagaagctccaatacataagggcctaacagtattttttaggagatgaaaaaaatgtttttcatttgcttgttgtaaacttaaatatgtatatagtcttttgccggcatttgtaattttaattgtgtgctgactgctatcaaccagtttacaattataataggcttctagtttatgaatatgttgagttacagcaggttgtgtcatatgtaaaatttcggcggttttagtataacttttatattttacaacggttaaaaaagtctcaatcttatgatctaacatagcaatgctccttgtatataaatatttattatatagtataatatatcataatttgtaattattaataactagtgatagcatattcttggaaagaggaggtaatctaatgaataataaaagtgatcgttcaactttgtggcagctattttgttcaatgtttatgttgagtgcttgtacatttggtggagggtttgttattgtatcattgatgaaaaaagaatttgttgaaaaattaaattggttacaggaagatgaaatgttggatgttacagctattgctcaatcttcacctggaccaataccggttaatgcttcggtaattataggttatagaattaagggaataattggatcattaacagcggttttagggactataataccaccaatggttattatatccattatcgcgattttttataaacagtttagatcaaatgttatcattgctattgcattgcaagttatgagagctggagttgcagcagtaatttttgatgtagttttaaatttagctaaaaatgtttgtgcaacaaaaagatttatatatatatctttaatgataatttcatttttttgtgcagttgtattagatattagtgctatgttgattattcttgtttgtttagggatcgggataattgatttatgttatgaattagtaaaaaaagaaaagagtgttggaggggatgatgttaaatgatattgttaaagttatttattagttttatccaagttggtctattttcagttggtggcgggtatgctgctataccattgattcaaaatcaaattgttaatgttcgggcattgatgtcaatggcagaatttacggatttaattactattgcagaaatgactcctgggccgatttcaataaattcagctacttttgtaggaacacgcttggcagggccccttggtgctttaatatgcacacttggatgtatcataccatcatttttcatttgtcttctgttagcacacttttattataaatatcgggattttagcggtgttcaaaaagtattatcggctttgagacctgcagtagttgctttagttgcttcagcgggattatctattttagtattagggctatttaattcagatatggcagcaatacatctagatcaatttagagttatagaatttattttgtttgtgggagcattatttttgttgagaaagtacaaaatgaatgcaattctaattatttttggaacaggaattattggtactctaatgtatttgcctatagtgctttagaaaatattatgtgatgtatgattttatcatgtaaatctcaaatttgtctcaaatttgtctcaataaaatatagatgattttaaaaaaatatacatacaatttattattttcataaaaaatattaaattattttcttaaatcaaaaaaaataattaaattaagaaaacaaagatttaattaatagttatttgaaagaattgacaagcctagaaaacaatgataacatagatgcagagatgtaagtgcgagatagccgtgaaaatgtacccagttggtggtacatttttgttttctctaaataatttatataagagggggataaaaatgatatctaagaaaatgataaagtttaaggaaattaaaataattgtttctatattgattgttttaatattagcaataggtgtttttctattgactagaccgaaggaagcattgaaattaaagaaagaggaaatgattattgaatatggtcaagcgatttcaactgatcctaaagattatttgaattttgatgaggtagacagtaagaaaaaaacagaaattttaaaaaatacaaaacttaaatccaatattagtaatgaagttgaaatcattactaatgaagacggttcgacaagtgaaaaagataaaggatatgctaaagttggtaactatgaaataactttaacttataaaaaagaaagtaaaacggtaaagattaaagtaaaagatacagttgctccagaactaacagttcctgaaagggtggaaatagttcagggtactgatctatcaacttatgattttaaatcattaatgatggcaactgatttagcacagttatctgattatacgatcgatattgctatgatcgatgtaaacgtacctggtgagtatagtgcaaaagttagtattgaagataccagtaaaaacaaaaccgaaaaagaatttagggtcattgttgttgcgcttgtagctgatccaaatgtagagataactagtgaagttcaaacagatccagttacagggcagaaaaaaacagttgtaacaacaaagccaaaacaaaatacaactactaatagttcatcaaattctggtagttcaagtagcagtaatcatagttctaataaaccttctagtggaaatacaaataattcatcaagtggaaattcagacagtacaaatcaaccatcaagtggaggtaattcaagttctggaggaagcggtagttcaggaaattcttcgagtggggatacagctaaacctgtagatagaacgatatatgtatcttattattgtaaagaaggtgatgcagttatttttgcagattggcaaggcaaagaatctgtttggaattcaatcaaagataaagttttacctgaaggatattatgattataaaattgaatatttaaattaaaatataaagacaattcctattggattgtcttcttttatttttaggaggtaaaagttataatgaaaaaatataattgcagagatccttgtaattaatatattttaagaaataatccaactgcaaccttattaaggttgttttttctaaaaagaaaggaatttaattgaagaaaattaaataaaaggttagataaatgaagaaaataatacgaaattggaaacagttgatcattgctatggcaatgattttcagtgttatatctacaaatttaagtactgtcagtgctgatgaaggtacagccagctttacatggggtgaagagatcgtgtatcctagctggcttgggaactggtcaactaaaatgtgttatattggtggaaatctagcgtactgtttagaagctagtaaggatacacctccagaaaatacaaatgcacgctatgtaatttctacaaatgaagctttattaaaagtcttatattatggctatggtggaccaggagatgtatttaaagatgatacagtgtcgacagataaggaaaaatacttatttacacatatcatggccagttatgcatacagtggtgatctatatggtggaaatacttgggattatttgaccagtattggtgttggtttaaaaacgagatatgatcaaattcagtctatgcctataccagaaaatattttacgttttaatgatcaaaataatcctacatttatcgcttattatgaaaatggaattcagcgtactgaagatatcacattaaataccaatgaatctgcggttgtatatattcctctgcaggatgaagttgagctgcacaatgtaactaaaggaactgttagtactggaactgtcgctgtaaatggcggtgatactttttatttgagcgcaccaatgaaagcattagatgattattcaagtggacagttaagtggggaaggattattgaaatatgctcctttagttattcagggaacaggaaattatcaaagtgaaggtactatttcaaaaataaatgatccaatgacagtacaattaaacgttaattggttaaaagttggttctttagaacttactaaaactaacactaataaagatttgatcgatggggctgtttttaatttaaaatcagtatcttttgatggttatgatgaaaatattacagtcactgatggtaagatcaaagttgataatctgcttgccggtacttataaattgaaggaagttttggctcctgacggttatctccttgatgaaacagaatatgaagttactatcaatgtcggtgaaactacttctaaagtagtggaaaataacgaacctactggttctgtttcactgacaaaagagatcaataccgctttaactgacggcaagtctggtgatgcttatttacagggcaatgagtataaacttatcgcaagagaagatattaccaataaggctggtacagttacttattttaataaaggtgatgttgtcgatactcagacaactgataatgccggtaaattagtatttgatgatctgcatatcggtaaatattatatcgaagaaagcaagagcaatgaatcattagtgttgaattctaaagatatcaatgtcgatattgaatatgaaggacagactgtttctaaagttctacgctctaccaatactgataatcgtgtcaatatgcaaaagatccagatccataaatcaggtgaaaaagacggtataagcggtcttgttaaaggattgcagggggctgaatttactttcaaattaaaaagtgaagtagaccatgtaggctgggataatgctgaagtatacgatgtcattactactgatgaaaatggtcaagctaatactaagtatctgccttatggtgaatatttagttcgtgaaacaaaaactcctaaggattatatcacagcacctgattttacagtatcagtgactaaagattacagtgaatatcctgatatcgctcaaatcaagatcattgatatcaataatcgtccttatacaacccagttaaaacttgttaaaaaggacctcgacagcaataagactgttactttgaatagtgcaacgtttaaagtaaaagccagagaagatattgtttctaatggtaagatcatttataaagccggagagacgatcaaacaaaaagttggcggtaagacttatgatagttttacgacatctgcagataatgtagtaatcccatcaggatcttacaatgttaatgacagtgataaaggtacaatagttttaccattgcagttagatgccggtaaatactatatcgatgaaataaagacaccgaccggttatttatcattagaaggtagagttgaatttgatgttgaaaacatcagagactatgatagagatcctgatggtgatccgattcttgaagtagtcattaaaaatgataagccggtaggagaattggaagtatataaagatgtatcatatggaatattggcagtacctaattctttagaaagagcgcatttaggtgatggatatgattttgttgacagatctgatctaagtaagatcaagtttagattgacagctaaagaagatatcttagatatggctgatggcagtatcgtttatgccaaaggagctcttgtaggagaatataatttagatcgtagcggatacttgaaggtatctgatctgccgatgggaacatatgaactgcaggagatcgaaacattagatggtgtagtattagatgaaactaaatatgaagtcaaatttgaacagacagatctaactactaaagtttataatgttactaaagaacttgtgaatgaaccaacgatcgttgaaataagtaaaactgatgttactggtgaagctgaattaccaggagccaagatgagtgttattgacgatgaaggaaatatcattgcagagtggatttcaggtgaaaatgcgatggtcattcagggacttagtgtagggaaaacttatacattgaaagaagatcttgcaccactgggatatgttcaggctaaagaaattaaatttactgtggccagtaccacagatattcaaaaagtccagatgatcgataaagttgtaacggtaagaaaagctgaaacaaatggaaaagcagtagaaggagtcgtgttacaggtcgtatcgaataaaacgaaaaatattgtcgatcagtggacagttgatgcaggtggaaatcataatgtaagaggactgcttgcaggtgaaacatatattttaaaagaaatcaatgtaccaaaaggatatgtaaaagcagatgatatgatgtttacagttgtagatgataataaagatcaaatgattgaaatgacagataatcaagttcagatcattaaagaagatgaggaaggtagtttattaaaaggggctagacttcaagtcatcaataataagacggatgaaattattgatgaatggatcagcggtggacatattattgatataagtaaagaaatgaagtcacttttacaaaagggagagaccataaatgatatgtatattgatgaagaagattcatcagtattatacagaatcacaccaaataaagatgccaaagattatacattgatgctgcagtctaatggtgaaacagaatattatcgtatcgatattgaagggaatgaaaccagtcatttagtaagaggattaaatcaaaatgatgagtacttacttaaagaagtggaagcaccaaaaggctatgcaactgcagctactcaggatctaaaagttgataataaagatattgtattgaagatggtagatgaaataacgaaaatcgagatttctaaattagatatcacaacatcaaaagaattaccaggagcgcatctacaggtgagtgatgaagaagggaatatcgtagacagctggatttctggtgaagaggcacatatgatcaaaggtctatatgtaggagagacttatactttgacagaaacaattgcgcctgatggatatcaggtagctcaaagtattgaatttactgttgatgatacaggagatattcaaagaattgaaatatatgatgatttactaatactgcctgaaacaggagataatatgagtattgattcaattgttcaaatgtgtttgttatcaggaatagtatttttaggtatttatatctatttgaaaagagaaagtgtttaaaaaaatggagctttttgggctccatttttttgattagaataatgttatttaagaataagattataaggattgataataccaggtgctacttctaaatattcattttttaaaaattcattgatgatactgcatagttcattgatatcagcatcgttgcctgtacattgtaagaaaagactttgactgccacaagtatctttaagttttaaaatataatcataatttttttgttttaataagttattaatatcttgtatttgaaaaatagaaatagttttcatgtttttgactccttttattaaaataatgatataatttcgatatagaaatgtcaaggaggatgaatatgacaaattcagaaatagagaaggcaactaaattagctcataaattagttgcttatgaagaaagtgaacaaagtgatattaaggctagtgacaataaatttgatgctttatggcaaagtatttatgatgtttgctcactagtacattttggaattttagatgaagttttaagtgaagaagaatatttagaaggagtaaattggttaaaaaagtatcaatctttaacaaaagattatcaagaaaaagaattagaattataagatgggttaaaaatataaaattaatgatgatgaatagcttgatattatgcgcataagatgaagtaggtgagaaaatgaaaatagttgatatgcattgtgataccattttaaaaatatatgatgatggtggtagtttattagaaaatgattttaacattgatttaaaaaaaatgttggcgggagattatttgttgcagaattttgcgatgtttgtagatcttaaagattcgctggatcctttaacaaaagctcaaagattgatagatttatattatcgtgaaattgataagtataaagatttaattagacccgtatttagttatgatgatattattagtaattatgataaaggaataatgtcagcgatgttaacccttgaagaaggtgcagtagtaaataatgatttagcgatacttcgaaactattatcgtttaggagttaggatgattactttaacttggaattatcctaatgggataggatatcctaatttggcaggtacaaaagaatatcaagatttgtatcgtatcaatgaccatgatgggttaactgattttggaattgaatatattaaagaaatggaacgtctagggataattattgatgtttctcatttaggtgatgctggtttttatgatgttctaaaatatacaactaaaccatttgtagcatcacatagtaatgctcgtagtgtttgtggtgttgctcgaaatatgtcggatgacatgattagacagttagctaaacgtaatggggttatgggaataaatttttgtggcgattttttaagaccttcatctagtggtggagcacgttcgtgtatagaagatatggtaaaacatattttgtatattaaagatctagtagggatcgattatattggtttaggaagtgattttgatggaattagtcaaaatcttgagataaaggatgcttcaatgatgccattgttagaaaaagcattattagaagcaggcttgacggttgaagaagttgaaaaagtattttataaaaatgtattacgattatataaagaggttttacgttaacatgacgattcgtcatgttttttctattgagttaatgtgtaatttattacatattaactaatttttttactgtatttgctgtgcggatcgtaattttatcacttatatttgaagtggcggtttttgatcaccaatttgttttttgataatttttacgactaaaggaccaaaaaatagaatttttataattatatactctttcatattcttctttaggatttccgatttcatttaaaagttcattataagataaagaaggaaacataaaaataagattatcatatatctctttattcttatttccccaccagtcgggagcattatctaagatattttttatttctttttgtaaaaaaataagaacaggtatatctaatttgaatttattttttatcattaattctattgtatttgtaagaacatttagattatctatatcacttaaaaagataacattaccactattaagatatgttgatacttttataaatcctagttctataaaatttgcttttaattcagacatagatatcttatttttcccgcttacgtttattccccttaataatgcaatatgttttttcatataacaatttcacctctaataatttttatttatattttctgtttttacattagttatgataaagatctttttacttttcagaattttattgctatcatcatattttcttatttgattttcaaatcttgtttgtaaaaaacataataaagaatattaatatgataacatatttattttatcgatacataaatatattgataacaatttaaatactggttacttgttattagtatattttattgcatagggatctaattgttagataatattttaaaatatacgaccaaactattttaattagatattcaaaagttgtttgtttaataaaaaatattttttattgaatatgtaaacatgcttacatattttgattttatatatagcttttaatcgatataaattcaatatttttttaattcgtcttttttatataaaaatagtaggttataaaatttggaaaaaataattacgaaagctacaaattgtaagaaattatgaatgatattatactaaaattagataataattaaggagagagaatatggaaagaatggaaagaagattatttaagatttttattagtgctgtattgggatattcaacaattattactagttttccaggattatatgcgcagagtcaaactactaatagtgatgaagaaattactttatggcaggaaagttttgaaggttcacaggatgagtttataaattcattagtggatgaagacaagggaagtaaaaatgtaaatcgaattcaagatgaaacaacacttgaaggtgatattatgaggtttttggatttgggatcaatagaagcttcaaagccacataattcaaccgaaattgttgataatctatttgatggaacgacggtgtcaaagtttttaacaaatgcaaatgtgcctagcttagataatccgatttgggtaaaatttgctttaagtcagggaatatctattagtcgttatcagatagctagtgcaaatgattttgaaagtagagatccagcgtcatggaaattatatggttcaatagatgggataacatatgatcttattgacgagcaaaatgacattatttttaatgatagatatgaaagaaagactttcgatttagctggggttacaaataaatatcaatattatcgacttgatattacaaaaaatcgtggaaatggggaaatgacccagttttcagaaattgttttaggtagtgatgaagaatttttggaagaaaatgaacaagaaggtatgacgacaaagatcgttggagggccaatttcagcctgggtcggagcccagggtgtaggctggagtggtgataaatcattagaagttagtggaattcattatggaaaagaacatggatattcatataataaactttatgatttaagtaatcaaaatattgttgtcacaaaagatacaaagctggaatatatgatttttccagatttgattgatgaagctgattatgattataactatactcagatgcatatggcagtagatataaaattcacagatggtacatatttgagtgatttaaaggctttagatgatcacgaaaatgtacttgctccaatggaacaaggtgatagtcgaactttggtaactagacaatggaaccatgtaagtggaaatattggcagtgttgctttaggtaagaaagttgatagtgttttaattggttatgataatgataaaaatgatcagttcccagaagatcgtgattatcgagcatttcgtagttatttagatgatatacgtatttatcaagcaagtgatcctgtgtatgagcatttagctgattatgtaaatatattacgtggaactaatgattcacctgatttctctcggggattaaatgttccagctgttactttaccacatagctttaatttttgggtaccggcaaatacgcaggtgaatggtcgcggatatgcagaacaaagaaagatatatacttatcaagaaaatgataattattttaaacatatgaccgttagtcatgaagcgagctattgggttggtgatcgtggtacatggcaatttatggtcaatacttcgattgatccaaaaacggggacatttggagtagatgaaagaaaagttcctttttcacatgataatgaaattgcaagagcatattattatggaattacatttgatgaaggttctaatgcatctaacactaagatggagctttcaccaactgatcatggggcagtagttagatttacgtttccgcaggatgctaaatataaaaatgtaatttttgattctttatatggaaatagtaacgaaccaaatacagaaattttagaatatgatgaagaaacaaacagttttaaagcatttactaatgatacaagtaatggcattggaatgaaaggaatgtatatttatggtacttttgataaaccaatgacttattctagagctgtagatggaaagcagggcgtggcttcttttgaagatgatgtagtagaaatgaaagtagcaacatcttttataagttttgatcaagctaaacataatttagaattagaaatagcaagtgatgatacatttgatacgatttatgatcgagcattaaaaacttgggatgataaattagatgttattgaagttgagggtggaacatttgatcaaaaagtatcattatattctaatatgtatagaatgtttatgtatccaaatttattaagtgaaaatgttggaacgaacgaagatccagaatggcaatattcaagtccatatggtggaagtaatactgaaccagaaatcaaagatggtaaaatgtattacaataatggattttgggatacttttagagcagcatggccagcatataatattttttcaacagatatgagcagtgagctagtaaatggtttagtacaacattataaagatgttgaatgggtacctagatggtcagcacctggaggtacatactttatgtcaggtactagtagtgatattgtctttgctgatgcaatggaaaaaggaattgaatttgacaaagaagatgcatttaaatcgatgatcaaaaatggtgcagttgtatcaaaagatgataattatggaagaaagcaactaacaacatcaatatttagaggttatacttcaaaagaacaagattgtggtttttcatggtcgatggaaggttatatcaatgattttggaattgctaaaatggcagaagatctaggttatgaagatgaagcggcatattatgctaatcgttctttaaattacgttaatttatttgataaacaaggtgataatgttgatgaaatgtggtttaaaggtaaagatgcttcaggtaactggtatggaccaagtctttatggaagcgatatttttgatccgttatattggggtgaaaattatgatgagacaaatgcctataacatggcggttacagttcaacatgatggtcagggattagctaatctttatggaggtcgtgataaacttgctgaaaaattagattctatttttgaaacaaaaggtgaaataaacggatggggcagtgatattaatggtgttggttatggacataaagagttaaaagaagctcgagaagtgaaaatgggtcaataccatcaatcaaatcaaccagcaaatcatattatttatatgtataactatgctggacaaccttggaaaactcaaaaatatattcgtgattcattacaacgttgttttattggaagtgaagtaggtcaaggaatgattggcgatgaagataatggtggaatgggagcatggtatgtatttagtgctctaggtttctatccagtaactgtaggtagtgatgaatatgcgattggttcgccactgtttgataaaacaacgattcatttagataatggtaatgatattacaattcgcgctaatggtaatagtaaagaaaatgtttatattcaatctatgactttaaatggtgaaacttataataaaaactatttacgtcacgaagatttgatgaatggtgcggatattgtaatggaaatgtctaatacaccttctaaatggggaagcgctgaagatagtgttccaacatcaattactaaaggaaatgaggtagctgatcctgaagaagatgtgacctcaaaagatgtgcatgtgacagatagaattactggtgatgtatatttaaatagtgcaagtgctcaaaatatcgaagatgttaaaaatttatttgataacacatctgatactagtgcaaaattaacaaaagatggttctgaactgatttacagttttactaaaccacaatacgttgatatgattacgcttacttctgcaaaagaaggtaaagctcctgatagttttaaagtatatggttctaatgatgcaaatgagtggcaattgatagaaacgagaagtgatttagaatttacctggtcacaatatacaagaccattcatcattcatcaggctgataaatataagcattataaaatagaattaactggtggtgaaaatttagctgaaattgagttattttcacaattagaagatttaaatgaagtaactttggatgatttaaaaggactagtagcacacagtgaaaacgttgatttatcaaatagtcatgaagaagtagtcaaattaattcatcaaagaattgatgaagctaaggaagtaataaatcaagaaggggttgaagcagaaaaaatgagacaagtttatcaagctttacaaaaagcattgcaagctatatcttcaactagtttagcttatgaaaaacaagaagctgaaaattataatagtcattctggaatagttaatgatggaccaaatattggaagtttaaatcctggtgattgggtttgttattacgatatgatttttgaatcaaacgctaacttttttgaattatattattctgttgaagacttcactcaatgtgataatcctttgattgaggttcgtttagatagtcgagataatgatccaatcgtaacatttgtaccacaaaaaacaggaacttggaaagattatatatatggtagtacaatgtttgattcatcacagaatattcaaggtgttcatgatgtttatttaacatttagcggtgatgtaaaagctggtgaaaatggtggactagcaagacaaaatgtagctaatatcgattggtttagctttaaagaattaatatcacttgatgtaaaagaaatggaacacggaaaagttttaaatgaggatctgacagttgaatatggaaaagattatacaattaactttgttcctgatgaaggttatgtttacgatcagatcttaattgatggtaaatcatttgaaggtaaagtagaaaataatagttttactttagaaaatattaaaaaggctcatgaaatcgttattacatttaaattaaaagatgaacaaccagttaataaaagtgacttgaagattgctgtagaattagccaataatataaccgaagaagatttagaaaaagttgttccagtagtggtagctgaatttaagattgctttacaagaagcaaataacgttttagcagatgaagcagctagtcaagaaacagtcgatttagcgtttagtcgtttagccaatgcaatgcatatgctggaattctataaaggtgataaaacagaattacaaaatttgatcaatcaaatagaaaaattagatgtaaataattatacagtggattcttggatggcattaacagaagcattacaagaagctaaagatgtaattgataatgaaaatgctttagaaagtgatgttgaagaggcttataaaaatttaagcaatgcatttacaagtttgcaattacgagtagataaaacaagattacaaaattttgttgatagtgtagaagatttggataaaaacaaatatacagatacatcatgggctcgatatgaattagtattacaaaaagcaaaagatgttttaataaaagaagatgcaacacagtcagaagtagacagtgtatataatgaaatcattaaagcatacttggatttaagactaaaaccaaataaagatgctttaaatgaattaattaataaagctagtttattgaataaagcaaattatagtgaagcatcatggaaagtaatgcaatcagcattagaagaagctaaaaatgttttagttgatccagaagcaaatgaacaagaagtaaaagcagctgtagaaatattagaagcaagtatcgaaaaattagaaatgaaaacaagtataaaaaaagaagctgtgaaaactggtgatacaacaagcatgtttagtgcattaggattgatggcatcattgagtgcagttgcatatctttcaaaaagaagaagaaaatagtttttaaattattggaggggtaggtctaaaatttataaataaattagaccaaacaaaaagtaccatttgatatcaaatggtacttttttgtcttatagaaaataagattctttttgaaagaaaaatttaattatatggatgtagatacaggttagatttttggggttataaaatatatcttaatttttaaataaagaaatatgtaaaattttaatttaagaaatcatattagtagaatattacgatatgatgtttcaattaacttaggaaggggttatcctatatgttgttttatttagattaagttattgtattagataataatttgctttaaatatttttattttataaatgaaaaatgacaagccgggaaattacttgccatttttctttattagttatcagggaaaggatactaataattacatgatatcaaagaaggatatctttatgattttgtagtcaatattatattgaagggaaaatcgaatatttcttttgactacattgttagtatagaattaaagaatggtaataatatatcaaaaatatcttaaaatatgtgataataatttttagtgatagtaatggtactattttaaattgtcgaaatttagtgtataatacagctgatggagagtagcatcagttcgcttgatattaaagaacgactattttttaagaattgtttggtattccttcaggttatattataagaaaacaattctgtagtactcggggttgttttgattaagaaattgtaatatttaaagaatgcaaaatgtagaattgataatgaaatatgttattaaaaattttactttttttgtgaaaggaaaaattatgcgagaaataaaatgtatagatattattgaaaaggttaagcagttgtgtattgaagcagcgtgtgatttacctgacgatgttttaaatgcacttattaataaaaaaaatgaagaagattattctttggctaaaaaaacactcgatgttttgatagataatgctgatctagcccgtgaaaatatgatgccgatttgtcaagatacagggatggcatttgtttatgtgacgatgggccaagaggtacatattgatggtgatttaaaagaagctattaatgaaggggttcgccaaggatatcaagaaggatatttacggaaatcggttgttgacgatccactatttgatcgtatcaatactaaggataatacaccagcgattatttattttgatatcgtaacaggtgatgaatttaaaattgttgttgctccaaaaggttttggttcagaaaatatgtcacagataaagatgttaaaaccaagtgatggagtacaaggggttaaagattttgttttaaaagtcgttaatgatgcgggaccaaatgcttgtccgccaatggtaattggtgttggaataggaggatcatttgataaagtaacgttgctttcaaagcaggcgatgatgcgtgaaatagggagtcatcatcccgattcacgttatgctgatttagaaacagaacttttagaaatgataaatgcgacaggaattggaccagctggatatggtggtaagacaacagctttatcacttaatattgaaactcatccaacacatattgcagggatgccggttgctgttagtatttgttgtcatgtggcacgtcataaggaggctagtttatgataaagttaacaacaccacttacagttgaaaaaataaaacaattgcatgctggtgatgaggtgatgcttagcggtattgtttatactggtcgcgatgcggctcataagcgattaatgagtctaatcgaagaaggaaaagaattgccatttccacttatggatcaagtcattttttatgttggacctactccgagtaaaccaggaaaggtctttggtagtgggggacctacgacatcaggaagaatggatgcttatgcgccaacattgatcaaacttggtttacgttcaatgattggaaaaggttatcgtcttcaaagtgttaaagatgcaattgttgaaaataatggtgtttattttggagcgattggtggtgctggagcactaatgtcaaattgtatcaagaaatgtgaaataattgcatttgatgatttaggtcctgaagcaattcggagattagaagtagaagatatgccattagtagttattattgatagttatggtaatgatcagtacattttaggtagaaatgattatttaaatatgagtaaataagttaggagtaatgttataatgtttaaaaaaagaagagattattcatattatagttcatataacagcggtcatagaagtcgtttaaaagtaggacgagttgcaatcgttgcagtgattgctgtaattttgattgtaggggtaacaacttttttaaatttaaatcgaattaaattgttagtgaaaggatattctttttctcaaacaagtgaaattttatctttaccaaaagaagatgaagaagaaatcatatctcatgataagatggatcatatcactaattggatcaacgagtcatctaaagttacattatatgatgaatacgaaaagtatttaggaatgaataagaagatggaatatgctgatgtagtagcatatgttgataacttatttgaaagtcaggtaccaaagttaaaaagtatgggctatactgaaaaattgatttggaatttaatcgatgaaggagctctacaagacgattttcaatatttgatcgatcataaatacacagctagtgatctagcaccatatcgtaaggtaaagggttataaacttcaaaatttagaagcttatatgaatgcatatagtatctataataattataattatgcagtttgtattactaattatccatttattatttcaagcaacggggaaccagcagataaatatacaattactaatccagataatttattaacattagtaaagaaaggattttatttaccagaagattatgaacctgaattagttgatccagaaattccagttgcgcctgattgtcaaaattcaaaaatgaccaaagaaacatctgcagctttaacgaagatgtatgaggcagctaaaaaagaaggactcgaattagtcttaaatagtgcttatcgttcatatcaaactcaagttgagacaatggctgattttgtaaaacgctacaatacccaatatgccaatgaatatgttgctcagcctggagcaagtgagcatcaaacaggattaggaattgatttaacagcccaaagtgttgttgaaggtaaacgaattacttttggtgatactgatgaatataaatgggtaatcaaaaactgttctaagtatggatttatcattcgttttgaagatggaactgacgggattacgggaattgctcacgaaccttggcacttacgatatgttggtgaagatgtagcaaaagaaatcgtagaaaaaggctggacttttgaagaatattgtttatataataatgttatgccagaagtgaagaaacaataatctagagaatttctctagattattttaatgaggtaaataaatgaaaatattgattacaactttaaactcaaaatatattcataagtcgctggcgttacggcttttatatgtagccactaaagattatcatgatgtggactttaaagaatatacgatcaaagaggatcttgaaaaaatcgtagatgatattatttctatggagatccaggtattagctatcagtgtctatatttggaatgttgatttaattaaagaattatgtgttaagttgaaaaaaagaaataagcatttgattattgttttaggtgggcctgaagttagttatgaaatagattattttttagataattttgaaatagattatgttattagtggtgaaggtgaagttgcttttaaacaattattggattgtttaaagaaccagcaggaaattgctgtacaaggcattagtagaaaagataaacgtgattatcgacaaacgcacccggttgatctgcagtatttacagacacttgattccccctatttattagcacgagatttggctgatatgtcaaaaagagttttatattttgaaacaagtcgcggctgtccgtatcagtgtcagtactgtttatcatcattagaaaaaggattacgcttttttagtctcgattatttaaaagagcagttagatttattgatggcaactgatgtaaaaataattaagttgttagaccgaagtttcaatgctaaaactgagcatgctcttgcgatattggaacatatattcaaacattatcgtccaggaatacaattccagtttgaaatcaatggtgatgttttggatcaaagaattattgattatattaatgaatatgccccagatggtctgcttaggtttgaaatagggattcaatcgacttatgaacctactaatgaaatagttaaaagatatcagaattttgaacgcttaagtgaagttatcagacagttgcaaactaatgataaaatagattttcatttagatttaattgccggtttaccgctggaaaatttagaaagatttgctaaatcatttgatgatgtatttagcttttatcctaaagaattacaactcggatttttgaagcttcttcgtggtactagtttgcgaaaagaagccaaaaaatatggttatgtatatgatgaaaatcccccttatgaattgctttacagtaacgatctatcaaaagaggatattgttaaaatccatttagcagaagatatgttagaaaaatattggaatagtggtaagatgaagatcacgatgaataaagtgatgagaaaagctgcttcaccgttttatttctttttagatctgggaaattattatcagcttcatcattttaaaagaatcggttatcaaaatgatgaattatttaaatacttaaatgagtatttaaaaggtgagtatttagatgaattgattgaagattatttgcttttaacaaaaatcaaacctaaaagatggtggaaaacaactcttaataaagaaagaagtcgaataataatgcataaattaattgaaaaatataatttaaatcaagaagatttatttagatatagtattattgaggaacttagagactgttatatagtagcgacatataaaaactatcagccagtaatcaaaaaataccctaagatataatttttatcttagggttaaatcttgctagtgatagtgtattttaaatgattttttgtttcaggtaagttatactgaatatgcgtggaggaaaaaatatgatagaaaatataagaaaaagagatggccgtttagtatcttttgaaacagataaaatagccggagctatttataaggcttttgaggcttgtggtggtaaatatgaattaaaaactgcaattgatattgcaaaaatggtggaaaataagttagaaaaaaagaaaagtgcgttgccaactgttgaacttgttcaagatacggttgaagaagtgctgattgaacaaggatatgttcgcgtagctaaggcgtatattttatatcgagctaatcgtacgcgagaaagagatatgcgatcacgattaatgaaaacgtttgaagaaataacatttgccgatagtaaagatagtgatttaaaaagagaaaatgctaatgttaatgctgatgcaccgatgggaacgatgctaaaatatggggctgaggcggcaaaacagtttaatgaaatgtttgtgttaaatcctaaacatgcgcgtgctcatattaatggtgatattcatattcatgatatggattttttgactttgacaacaacctgttgtcaaattgatattgttaaattgtttgaaaaaggattttctacaggacatggagttttaagggaacctaatagcattagtgtttatgcagctcttgcttgtattgccatccagtcaaatcaaaatgatcaacatggcgggcaagctattcctaattttgattatgggatggcaccaggagttaaaaagtcttatataaaacatttttatgataatcttgctaaagccataactttgcttgcaaaattggatggtgataaaatcgttgtttctgttaaggaacaaatacagttacagccgactttagatgttgatctaaaatttaatcaaatgctaaaagaaattttaattgcgaataatattgatgaatcgatacttgatgaaatcattgattttacaatttcaagtgcttataaagaaacagataaagaaacttatcaggcaatggaagcctttattcataatttgaacacgatgcattcaagggctggggcgcaagtaccatttagttccataaattatggtatggatacatcaagtgaaggtagaatggtaatgcgtaatattttattagctacagaagcgggcttagggcatggtgaaacaccgatcttcccaattcaaatttttagagttaaagaagggattaattataatgaaggagagccaaattatgatttgtttaaattagcatgtaaaacctctgcaaaacggttatttcctaatttttcgtttattgatgcgcctttcaatcgacaatattataaaggtacgccagaaacggaaattgcctatatgggatgtagaacaagagttatgggaaatgtttatgataaagagaaagaaattagttttgggcgtggtaatttaagctttacatcaattaatttaccaagactagcaatttatgctaatggcgatgttaataaattttttgataaattagatgagatgttagagttgtgtattcaacagcttctagaacgttttgaaattcaatgccgtcgtaaagttagaaactatccttttttaatggggcaaggtgtttggctagatagtgataaattgaaagcggatgatgaagttcgtgaagttttaaagcatgggacattgacggtaggttttatcgggcttgctgaaactttaaaatctttaattggtgttcaccatggtgaaagtgagcaagctcaagttctaggactgcagatagttggacatatgtctaaagcaatggaagcggcgacaaagaaatataatttgaactttagtttgattgcaacaccagccgaaggattgtcaggtcgttttgtgagaatggatagaaaactgtttggaaaattagaaggaattacagatcgagattactatactaatagttttcatattccggtgtattatcctattagtgcttttaagaaaataaaattagaaggaccatatcatgctttaactaatggtggacatataagttatgtagaaatggatggtgatccaactaaaaatttagcggcgtttgaaaaaatagttagagcgatgcatgataacggaattggatatggagcaataaaccatcctgtagatcgtgatcctgtttgtggttataatggaattattgatgatatttgtccgttgtgtggaagaagtgaagaagaacatcatggttttgaaagaattcgtcgtattaccggttatttagttggaactttagaacgatttaatgatggaaaaaaagctgaagaacaagagcgcgttaaacacggtattgaataatgaagattcgtttatttggaactgttgatgattcaatcgttgatgggccagggcttagatatacaatttttactcagggttgttttcataattgcagcggttgtcataatcctaaaagtcatgatataaatggtggctatttaaaagatattcaagatattttatcagaaataactgctaatccactattggacggaataactttatctggtggagaaccgatgttgcaggtaaagccattaattgagatatgtaaagaggttaaagcaatgggattaaatatcgttgtttatagtggttttacttatgaagaaatacttaaagatgctaaaaagaaagagctattacagttatgcgatatgttgatcgatggtaaatttgaacaggataaaaaaagtttagctttattgtatagaggttcagctaatcagcgtttgatcaatgtacaggagtcattaaaacaaggaaaagtgattgaatatcaaatcattgataatgaagttaaaatataggggcaatattattacttttaataatattgcttttttataataaaagaggccagttatttggcttcaaaataattagtttttaattaataagtttgcttgtaaccaggttctttcttcattagatagatatggtgcaacatgatcaaaaactagctgttgatagtcgttgatttgtttaatttcatgatctgataataatttaagatccaaaccatctaaatcaaaaggaaccatcgtaattggctcaaattttaaaaattgtccatattcattgttagtgacttcaacacataataattcattttcgtggcgaacgccatgacttccttcaatataaatacctggttcatcagtagtgatcatccctggttcaaaagcacacattggtgcccagccaggacgatcatgcggtctaaatccgtttggtccttcatgaacgtttaggtaatgaccaacgccatgaccagttccacagcgataatctaaattatattcgtaaacaattcctctagctaaaatatctaaatttgggcctgttgtaccagctacaaaatgagcagcttgtaagcgcatcatagcttttaaagcaatcgtaaaatcacgtctttcctggtcactgataggtcctaaaacaaaagttcttgtcgtatcgatcgtaccgtctaaatattgaccaccagagtcaatcaataacattccttcatttgttacttttgcacatttaccaggctgagctttataatgcattaaagcagcattagctttataaccacaaatagtatcaaagcttaaatcacgaaaatcattttgaacttttctaaaagcagttaatttatcactaattgaaatttcatctaattcgatttttccaacatttgtttttagccagtacataaattttgtcatggcaacaccatctttaatatgcgcatttttagtagctttgatctcggtctcgttttttatagctttaaagcgctgggttggattaatcatatttttaatttcacaatttaaattactgcagatttgataattaacgatttgcttatctaataatactttaccagttaattttttaacatcttcataaatgtcattatatgctttgatattaatgccatctctttttaaaatagctgccattttaatatcaacaacattgttttgaacatataatatagcatcatctttattgataagggcataagctaagacaacgggattacattcaacatcattaccgcggatattaaataaccagacgatatcatcgaggctcgtgataatatgatgttggcaatcacccattgcttcacgtagacgctgtagttttgaagctcttgattcgccgcaatatttttcatcatataagtaagctggttcttgtgaaatattaggacgatcatgccaaacttcatcaactaaatcgatatcagtaatcaatttgttatttaggtgttcagcttcttgagcagacatcacgcgaccatcaaatcctaccgttttatcgatgttttgatcaagatattctttaatggtagggacacctggcattgccattttcattaaaatgataccactgccttctaattgctgtttagcttggataaaataacgaccatcagtccatagacgagcttcgtttgagctgatgactaaagtacctgcagaaccagtaaatcctgataagaatttacggccattaaagtattcaccgacatattcgctttggtgaaaatcactagtgggaacgatataaatatcaattcctttttctttcattaaattttgtaatttttttatattttcttttatcatctttacaacctcactagttatactttatcacaagtagttggggctctcaatggatatgaaaacttttatttaaatttatttacaaaagtaatgatggtaaaagcagggacaaaattataaatctcttgataaaagagctaggtatttttgattagacaaatctaaagaattgtctaatgaatttttttagttaaaagttataataaaacatgttaaaaatgtatatttgcttatttaaaatgtaaagataatattaagaaatctcttgtaacccctgatatgactagggttacagcagaaatgataaaatttttaaaatgatagattattatcattgcattttttttagataggagtatacttatctcaagcaaagggggttgtactgtggatgatgtaattcaaagattagtagaaatagaccgtaagtgtgttgagcgcgttgaacttgcaaaagcaaagaaattagatgcgcaaacaaacatgaatgaaaaaagaaaagagatatatgaaggttttgttgcagagcaaaacaaaaagattgaggaacataagacagaattaatgaataagaatcaagaagatgctaaacagcttgatcaagattataaagatacgttagcaaatttagagaatctttataatcaaaacaaagacaaatggatagatgaaattgttaaaagatgtttaaagtaagaaggtgaaggaatggctttatcgtcaaatgcactatgtgctaaggcaaaagcgatgtatggttatcgaatcggtgaagaaggttatagtgatttatgccggaaacaaacacttggtgaaatggtaacgtatttaaaatcgcaaacaaagtataatggtgttttacaagatattaatgttagaaatgttcatcgccgtcaattagaagcttctttaaataaagagtattttgaacggtgtgctagattaatgaagtatgcaccaaaaaagaatcaagatttttataatcaggaagttgtaggaattgaggttcaattaattgttgataaggttgtcagtattaaggaaaaggatcaggcgagtttttccttagagataccggattatttagcgggtaaaatgagttttaatatttatggtttgatcaatgttgataattataaggatttagtagtttatttaagaggtaccaggtattataaaattttagctaattttgattttactgctccgattgatatcaatgcgttagaaagacagttaaaatctttgtattataatacttatgtagatgctattaaaagtaattttaagggtaaggagcaaaaagaactattagatgttttatcaacatcgattgagttagctaacattactaaaatttatcgatttaaaaaatattttaaagaatcgaatgaaacaatcagaaattcattatgtttagaacattgtagaatgtctaaaacaatgttagattcattgattgaagcacggagtgctaaagaattgttggaactgctggctaattcaaaatataagttatatcttggagataaggagtatgcttatattgaatactatgtagaggagattaagtataatattgcaaaacgatatatgcgcttttctggtgatgcaccactagtttatttaacttattcaatcttacaaaaggttgaaatcgataatttgaaacatattattgaagggattagatataaaagagatgcatcaagtattgaagagatgctgatctttgcataggagggattattaatggctattataaaaacacatttctttaatatttcttttgaacataaagatttaatgaaagtgttgatcaaaatgagtgagcatcaagatgaaatgtttccacaagattctaaaaagatagcgaataatgttaaaggggtgtcaattatggatgaagtcaatccttataatgaaccacttgataacatttatcatatattaagtcgtttaaatcttaatagtgatattcaagataaagaatttaaggaaattaatttgtataatgtaaataaattaattgatgatattaatagtcaaattgataatattgttaatatcaaagaaggaatcattaaagaaaaagatgaaaatgatgaggctgttatattattaagaaatcttgaagaatcgaaaataagtgtagatgatgttcaaaatacaaaatatattacttgccgctttgggaaaattcctgtaggtgagtttactaagattcaatattatcgagattatgaatttgtttttaaagaattaaatcgctcaaaacaatatgtatggatcgtttatgcgggacttactaataacatttcagaaattgataatgcattttcttcaatgtcatttgaacttattaatttacctgattttgcacatggtaaaattcatgatgcaatcaatgaattagttgaagaagcagcagcaatggaagaatatataaaaagaatggatacaaaattagaagaagtaaaaaataagtatcaaaaagaattattagaagtatttactagattatataatttgaaacgattatatgataaatgtcgttatgttgttgatttttcacaaaaagcatcagtttatactttcagcagtcttgatttaaaagaagttgaaactaaatttgatgatatcgacagcattaaaataattgaattaccagttgatatttatgaaaaaagaaatattattgctccagttattgtaaagaataatacgttgtttcaaccatttgaaaatgttttaagtgttacccttggagatgttttcgatccaacagcgttagttgcgatacttacaatgataattagtgctgtatgtgttggagatattggtgttggtattttattgttagtattaggattattagtaaatattaagaaaactaataattttggtggcatgttaaagcgaatcggagctgtaattttagttggcggattattttatgggacattgttttatcaaattgagttatataaaccgcttttcaatttaccaatgcatgtaattcatacatttttatttggatttggtatttggatcattacaatgattattttgataattgcaaaaaaagttacacggaagtcgataaggatataggagggatataatggcaatttcaagattaaacttagtcagtattaattttgataagtattgttacaatgaagttttattaaaactttttaaccatgatgattttcatcctgagttagcctctaagtttattgatagtgtaacagggcttagtgtttataatcaagataatctttatgaagaaatcttggtacgtttaaatgatgcctctaacaaatatcattttaaacttgaagaaataccagttgaaagtaatcaaataaatgtattaggggttaaagaatatttagatgatttgttacttgatgttgaacgtattgatgcggtaaaagtccaacttgatcaaatggtgatcgagaatcaagaagcaatcattcagttacagcatgttgcggatatcgatgttgattttgatgatttgtttagctgtaaatatcttcaagtaaggtttggtaagattccagcaaacaatgttgcaaaattagattattatgaatcattaccgtttgtatttaaaccatttcataatgatagtcaatttatctggtgtatgtatattacaacacctggagatgcaccggaagttgataatattttttcgtcactgtattttgaaagaattcatattcctacgtttgttcatggttcgccagaactagcaatcagtgaaattcaagaagaggcaaatgtagctatagaacatagtaagaagctggaaatgcgcattaataagatgtttgcaaataatcaggataaactaaatgaaatttatacgattgctaaacacttaaatgacgtatatatcatgcaaaaatacgtagttgttattggtgataaacttactgtaaatggttttgttccaactaaaaatacaaagaaatttaaagaagattttgaaagtattgaagcagtaactgttgatgtaaaaccagctaatagcgatgttaggttgtcaccgccaacattacttaaaagtaattggttttctcgaccatttcgaatgtttgtcgaaatgtatggtgtacctaagtatagcgatgcggacccaacgttgctagtttcgttgtcgtatactttattatttggaatcatgtttggtgatgtcgggcagggaatcattctttccctagttggattaattgcttataaaaagtttggtttgcaattaggtgcagtaggaattcgtttaggaatttcgagtactttattcgggattgtttttggatcggtttttggaaatgaagaaattttaattccgatgtttaatgctatgtcaccagataacacaatgacattattgatagcagcaatctgcttaggaattattttaattattatttcaatgtcatttaatgttgttttgaatttgaaaaagaagaatattggtgaagctgttttaagccaaaatggagtgtgtggattagtattctatgtttctattttaggtttagtgttgaatatatttttaggattaggttttgttaatatgatttatgtaattatattaattattattccgttattatttatattcctaaaagaaccgctaattagaaaatttgaagaacatgaagcaatgtttccaaatggatttggggctttctttgtagaagggttctttgaattgtttgaagtagttttatcttttatcactaacacaatgtcatttttaagggttggtggatttgttttgtcacatgccgggatgatgttggttgtatatactctagccgaaatggttggaggcgttggtgaattagccgttattatatttggtaacgtttttgtaatgtgcttggaaggattgattgtaggaattcaagttttacgtttagagttttacgaaatgtttagccgatattatgaaggaaacggtatcccatttaaaactattaaagaggattaaaaatcgaggaggaaattattatgacagttttagaatttattttaccagcattagtagttattttattatcattacctttaattaaagtatttacaggaaaagtaagtgtaaaaagtgcaaaaattagattagcatcacatgttgctggttttgctggcgctgtatgtttagctttatatttagcagcaattactaacggggtatatgctgaagaagcagcagttattacaggaacgattgctcaaggtttaggatttgttgccgctgctttagctacaggtttatctgcattaggagctgggattgcggtagctgctgcagcacctgcagcaattggagcattctctgaaaatgaaaagaactttggtaagtcattgatttttgtagccttaggtgaaggggttgcaatctatgggttattgatctcaattttgattatcaacaaaatctaatcgaaagaatgtgattattgtgcgattttattgtataagtgataatgtcgatactcagattggacttaggctagtaggaatcgaaggacaggtagttcataaaagaagagagtttctagaactattggaaacaaaattaaaagatgattcaattggaatcatcttgattactactaatctgattgaacttgctcctgatattatttcagaaattaaattaaaacaacaaaaaccgttgcttgtagaaattcctgatcgtcatggtgaatcaaagattggtgaaactattgataaatatgtttctgaagcaattggtgtgaagttatagagagggaatgctatggaaaagaaagaacaagtatttctttatatgaaagaagagattgaaaggctagctaatctagaagaagaaaagattttggctgaagctaaagaacttgaagaagaggcttataatcaaattaaagctgaagctaaaaaagatgctgaggcactattagctaaagaactagtagagatttcttctagtgctagtgtcgaggcttctttatctcaagaggaaaaaactaaaaaattagttgttaaaagagatgagtatgtagcaaatatttttaaagaagctaaagaaaaattagttgcatttgtagctagtaaggattatcaaaagtatcttattgagcatatcgaaaagattggtaaattatatcaaatggaagattcaactcttgaacttagagaagaagatatgagatataaagatgaattagtaaaagcttatggtgtggatttggaagttgaagtaagcgataaaattaagataggtggttttattattgaaaataaagctactaatgtcgttgttgacgaatcattagactctgctttagaaaaccaaaaagactggttttttaaaacatcaggattaatgattaaatagacagggggttaacatatgaaaaatgatgtaatttattcaattaatgggcccgttgtaaaagtaaaagatacagtttctttttcaatgttagaaatggtatatgtaggtaatgattcattaatgggggaagtaatttctgtttctaaagaatttactactattcaggtatatgaaactactactggtcttaaacctggtgaaccagttgtttcaaccggatcaccaatttgcgcaacgttaggtcctgggatcttaagaaatattttcgatggaatcgaacgtcctttaaaagctcttgaaaaagaatctggagcatttattagagcaggaagtaatgttgattctttggatgtaaataaaaaatgggatgtaacaatgacagttaaagctggtgaccaagttaaaggtggcgatatctacgcaacaactccagaaactgatttaattgttcataaatgtatggttagcccattgattagtggtaaagttattgaagtggctaaagatggtcaatatacgatcaatgatgtaattatgaaaattgaagatgaaaatggaaaaatcattgaatgtacattatgtcaaaaatggccaatcaaacaagctcgcccagtaacaaaaagattaccgataggaattcctttagtaacaggacaacgagttattgatacgttattcccaattgctaaagggggtaccgcagctatcccaggtggttttggaactggtaaaacaatgacgcagcatcaaattgcaaaatggtgtgatgccgatattattgtttatgtaggatgtggagaacgtggtaacgagatgacacaagttcttgaagaatttagtgaattgatcgaccctaaaagcggtaaaccacttactgatagaacagtgctgattgctaatacttcaaacatgccggtagcagctcgtgaagccagtatttatacgggaatcactttagctgagtattatcgtgatatgggatatcatgttgctatcatggcggattcaacttcacgttgggctgaagcacttcgtgaaatttcgggacgtcttgaagaaatgccagctgaagaaggttttccagcatatctgccatcacgtttatcacaattctatgaacgcgctggttacatggaaactttgaatggaaaagaaggatcagtatcgatcattggtgcagtttcacctcaaggggccgatttttcagaaccagttactcaaaatactaaacgattcgttcgttgtttctgggctcttgataaagcattagcttatgctcgtcactattttgcaatcaactggacgcaaagttatagtgattatgtttatgatctagaaaaatggtatagtaaaaatgttggtccaaaatttgtaagtgatcgtcaggaaattgcttatatcttagctgaagaagcgaagttaaatgaaattgttcaattgatgggaccagatgtgttaccagaagatcaaaaattaattattgaagttgctaaggtagttagagtaggatatctacaacaaaatgctttccataaagatgatacttatgttccaatggaaaaacaattgaaaatgatggaagtaattttatacttaaataagcgttgtaaagaagctgttagtcaaggtaaggttgtcagacgaatcgtcgatacaggtatctttgatcaagtcattaagatgaaatatgatattcctaatgataatatcgataaattagatacttactatcaggatattgatgaagcaattaaatcagtagcgtaggaggaaaatgattatgtcactacaatatgtaggattaaatgaaattaatggaccattagttgttttagaccacgttaaaggtgcttcatacgatgagatggttgaaatacaattaaaagatggaacaactcgagctggtcgaattgttcaaattgaaggtgaaaaagttgttattcaagtatttgaaggaacgaacggcttatcacttgaaaatactaaaacaaaattattaggtaaaccaatggagttaccagtttcaaaagaaattttaggacgaattttttctggggctggtcgtccaatcgatggtttaggtgaagtttatgctgaagctgagatggatattaatggattaccattaaatcccgtatcacgtgtttatccacgtaactatatcaatacaggaatatcttcaatcgattgtttagccactttgattcgtggtcaaaaattaccgattttctcagtgtctgggttacctcatgatcgtttagcagttcaaatcgttaaacaggcaaaaattgctgacgaatctggaaaaggatttgctgttgtttttgcggctatgggggttactaatgatgttgctgaatactttaaacgcagttttaaagaagctggagttatggaaagagtagtaatgttcttgaatctatcaaatgatccaattatcgaacgtatcttaacgccgcgttgtgctttaactgctgctgaatatttagcgtttaaacaggatatgcatgtgctagtaatttatagtgatgttacttcttattgtgaagctttacgtgaattctcttctagtaaaggtgaaattccaggacgtaaaggatacccaggatatttatattccgatttggcttcattatatgaaagagcaggaatcattaaagatgctaaaggatcagtaactcaaattccgatcttaacaatgccgaataatgatattactcaccctgttcccgatttaacaggttatattactgaaggacagattaccttggatgttgatctaaattcagcaggtatttatcctccagttggagttttaccatcacttagtcgtttgatgaaagatggtattggtgaagggtatacccgatctgatcatcaagatatcgcaaaccagttatttgcgtgctatgcccatgttcaggatgtacgttctttgacatcggttattggtgaggatgaattatcagacatagataaaaaatacattagttttggtcgtttatttgaagaatattttattaatcaaggatttaatgctaaccgtagtattgaagagacattggatttaggttgggatttagtatccgttctacctcgtgaggcattagatcgtttggataatgcgttgttagatcaatactataatcatgaaaaagcattagaacgttttaatattaaagaaaagaagattattaaagaattacaagaagcaggtgattagttatggctttgaaagtagttccgactaagggtaatttaattgcaatgaaaaaatcattgcagcttgcaaacttaggatataatctaatggataaaaaacgtaatgttttaattaaggaaatgatgactttattggatgatgttaaaattattcgtgatcaaattacttcatcatatcaagaagcttatgatgctttgcaggaagctaatatttcaatgggattaattacggatattgtcaatagtacactagaagattatgggatttcgattgcatatcgtagtgttatgggggtagaaattcctaagatttcatatgataaacagcctttaaagatggcttatgatattgaacgttctaattcaaaggtagattatgcatataattgcttctacaatgtaaaacaattaactgttttattagctgaagtagaaaatagtgtttatcgtttggcgaatactattcgtaaaacccaaaaacgtgctaatgctttaaagaatatttcaattccacgttttgaatcaacaattaaagttattacagaagcattagaagaaaaagatcgagaagaatttacacgtcaaaaagttattaaggaaatgaaaaaataagaatatatcaatttaagttataaataaaagatggtttgattaataataattaaaccatcttttatttttgataatactattattgaaattaaattattaagaaagattttatttttgaataaattttatgttttcatttgttagtgaatatgttaaatctgtaggtaatttagaacgaatatgggttaatttatcattttcgattttcccgttccatgttgctacaacgacaattttattagctagttcttttaaaaatgctaacatatcaatattagaatcttttgcataaagaattctcttattatctaataataatacgtctttatcgtatgtttttagaaaatcattcatcactttgactaaatcagtagaattgtctttaaaaatattatctaaatttaaaataggagtgccgctttctttactatattcgtgaataagttttgatttgccactaccaggggtaccaataattaagattaatttattattggtgttttttgctgcttcgatttctttaagtagttgatccatgttatttacctcctttttattaaaatgaatcgtatattcatattttaacattgttggtaattatttaatagtaatattataagatatttcctggggaataatgtttaattgggtaaaattattgtgaattttaaattattttgattaatgactaataaattataatataagtgtactagctattgtaatacagttaatgagatgctataataaaactgtactagttaagataatacagataggagtggatatcatgaaaaaaattatattattgatcatggttttagcgatggttgtgccaataccggttcaagccgttaataaaacaacaagtattgatgcttatagtcagggcgatgaaattaaaggtgattgcttagctaaagaggttgatctaggcgataacttaaagggaactttagctgttaataatgaaggattaaagtttattgataatgatgattttgtgattaatatcaatcagtcggtcaaactttttgaggtaattgatgatattgataatgatggtataaaagatattgcagtatatgtaaaggctaatagtggatatactaattttagaataataagttctaagaattctaaaattctttatgaaaaatcattaactcacaaaacaattgatacaaataataatttagttacagaaaattcaataatcagagagatattatacagccaaaatattgtttatttgatctatgatcatcatttactagcaatcaatgttaataaaaagaaagttatttttgatcatgaagaatctgataatatttggcagatggcaatagttgaagaacaaattatttttactacccagcagggacaattggttagtcttgataagataaatggaagtgaaaattatcggcagtcattaactacaccaatcgaagcgaagaataaattatataataaaactcaagaagtaaatttaaatttatgggatcttttatatgtagatgacaaattgtatgttagtagtgaagaagataaaatttaccaaataaatagtaatgatggtaatgttatcaaagagttagaattggggatagtggatcaagatgaacttagtaaacgattaacagaacagacaacatataattataatgatggagaattaagtgttttttcaacgggagttttttctaaagcgtttaatggttataaaatgaaaatgctcaaagataatttgatgcttgttgaagcatatttaggtgatcataactattattcgcttgaagagtttggggatttgaataagggaatagaaccagcattattgttgatcgatacagaaaatttagaaattaaaactaagatcaagctagaacagtataatttagctagttccaatgcacttttaacaacttatcaaggtcaagaggttttagtaattccaagcagtattaataaaggagtattaagaatttctatttactcagctgatagtggtaagttgattggacaaaatgatttaaaaaatttaggtgttggtttagaaaatgtaaaagtaagaatcaataagtacgaaaataattatttactgcagatcaatgatggtggtagttatattttatatgatgatttaaaaacaattggatcattaggaagttcaaaaatcgttaataaaattattgatttaaatgatggaatattggtttctaataatcaaaatggcaaaattgatgagatatgtaaattaggattaaatggtaaagatgatattttgatgcaggtaagagtaccatcaaattatttaaataatggttttgaaggaatcacttatgatcaagacagtaatcaagtattaacattagttaatgaagtaaataatcaaggagaaattattgctagtcatgtattaataattaatgtaaatgatggtaatattattgctgataaaaaagtattattggaaaaaggaatcgatgaaaataataaatattttgaaaattatttaattggtagtgaaatcaagtattttagtgatttaaataatgatggcaaaaaggaaatattagtagatgataagataattgatggaaatacttttgcttatagatcacagtatgaacagatggtagaggataatggtacgattattgatgtaggtgatttgaataatgatggaatcagtgatcttgtaagtgttggtgaaacagaaatgcgtgtttattattcaagtaagaatggttttgagataagttatcaaaaaactaatattgtaaaaaaatacgataagaatttgttgaataatcaacaggttaaagttattgatgatctagatcataatggtgctgatctatttgtgataaatgctcgtaatagtaatgattgtcaatattatcaggtaatcaatcccaaagatttattggttagatttaatctaatggaagaaggggtgtatgactggggtgagtcatttatgataacccagatggattttaatcaagatggtatcgatgatttgatttttaatatgccagagggtaatcaaagaatattaagtggtaaagatggtagtgtaattaaagaaatagctagagatgattatgatggtggaagtagttcaccaactgctttagaagaagttataccaattaattttattgatgatggtagtaaagtttatcaattagaagatttgaataatgatggaattaaagaatttggttatagctgttatgactatagttatgataatattaaatttaaaattctagatggaaaaaatttagaagagttaaaaacatgtagtttggataacactgatctttatgattctacgattattcctgttcggggacaaaataagataataattaaagatagtaatcataatcaaatttatgattataaagatgaagtattagttgccggttgccaaatcgacgtaaagagtgcaagttctttagcagatggtcggattttgattgagggtaatgatagacagttatatgcatttaatgatcaatgtgattttaaattagttgattttgaagaaaagtatcatagtggtaatattacgattaaatatcaaagtgaaaagtcaggtataattagtgtttatgatcaaggggtattgattgcaactagcactaaaccagaagttgatctaaagttattggaaggaaaacatcggttagttttttcttatgatgatggtcaaggtaagattacacatataacgaaacaaatagaggtaaataaatcttcttttattaaatatttaattattttattttcagtagttattatcttaataggagcattacttgtagtatatccaaaatatcgtttagaaaagaaggcaggtgctaaatatgcaaaaaataattaaagttgagcatatgaataaatattttaattcatttaaggctattgatgatttgtcttttgaattagatggtggaaagatttatggaataattggacctaatggtgctggtaaatcaacgacaatgtcattattgatgggacttatttttcctagcagcggtagtggttcaataaagggtcatccgctaggttctaatgaggcaaaaaaactgatggggtattcaccagagtttcctaatttttatagtgatatgagttgtttagaatatttagtatatatgggacaattatcaaacttagattatgatacggcacttaacagagctttagagttattagaggaatttgatttaatggattataagttgaaaaaagtagcaaagttttcgacaggaatgaaaaaaaaggtaggattgattcaggcgatgattcatgatccagaagttttattattagatgaaccaacagctaatcttgatccgacaagccgcagcgaaatcattcaaagtttaaaaaaattagtagctcagcgtaaaatgacagtattgataagttctcatgttttaagcgagttagagatgataattgatcatgttgtcatgatcaataaaggacatgttgtgttaaatcagcctattgatattgtccagcaggaatttaatcaagaaaaaatattagtatcgacaaagaaaaacgagctattaaaaaaatatttagacattaataattataattatagtttggaaaaaggtgtttttagaatagctgccaaggataaaaaagcatgtaaacaaagtatcattaaatttatttatgaaaatgaaatagaattaaatttatttaaagaagagatgataactttggaaaaattatatcaacaggttatggaggataaagaaaatgaaagtactattgtctaaaacatttataaaaatgtttaaagtgcttcctgttactattattggtttaattagtggtggattgggttttttattcgcatatatttataataatttatctaaaagtgttttaacctatgatcgtttttctagtaatatattaactgtttatagtttgatagcttttatgttgattattggaataatgatttgggtgattagtgctaatagttcttcagggttatttgcaaatgaaattcatgaaggaacaatgcgattattattatctaaagaaattacaagatttcagttagtgacaggaaaaattttaggaatgcttttgggaagtgttgtatatcttattatgagttttgcagtatttatattgttcttttgtttatttagcggggtggaaaaagatatcttattattggttataaagggaacgagtttatttattatttatggtgttttagtaatctttataattggtggactaggaacgtttttatcaacgatatttaaaaagaaagtaccggctattttaattatggtggcattaagtggtttgatttttggaattatcccaattattagggtgattctaatacaattgggttactataatcagtttcatttatatttgattgacctaaattatcattttggactaatctttaataattttttgagattgatggaagatttaacattgtcacaaagtatagatggaatatttacggtatttactaatttgtatatacctaaagctattgatattgatgtgacacttattaatggtagttattatgatattaataatacattaaatagtttagttataataattagttatattggagcagctattattttatatggtttatcatttaaaacgatgttaaaaaaagatatttaagttaattgagtcgtgtctaacatgactctttttcttgttgttatagtgaaatattgttttaaatgaaaaaataattttattttttaaataaaaaagtatcatattgtcgccaataatggtatagtataaaaggtaattattatgtatatgctgctttgattatagattaagcatggtttttagggggatgacatatgagtaaaatatgtaaagtaaaagatatattaattggtgagggtattccaaaaatctgtgtaccagttataagtgataatcatcaatctattattacagatctaattagattaaaagatcttgaaattgatttaattgaattaagaattgattattttaaagaattatctaatcgccaaaaattaatagaattatttaaaatgattggttcgttagaaatgaagcaggctcttattttaacgtatcgaagtgctaaagaaggtggtttaggtgaattaagtcatgaagaatatattgatctttatgctttagctttggaaagtggcgcttttgatatttatgatgttgagttatcaagcggaactaatgcgattattactttaaataatatgattcatgaggcaaatcgaaaggttattatgtctagtcatgattttactagaacacccagcttagatacgatgttggaaaaaactaagcagatggattcgttagaagctgatataatcaaattagcggttatgccagaagattataaagatgttttattacttttggaaatgacattacgtgctaatgaaatttatgataaaccaattgttacaatgtctatgtctaaactagggatagcaacaagatttttaggtgaacagtttggttcagcgattacttttggtaaagatcgtgattcttctgcatcagggcagatcgatattcgctctttaagtgcagtgttgaaaatcgttcatgaaaataattgaagtttttaagcacctttaaggtgctttttgattgattatttttcaccttttttttgatttgtcataatatatattaggtgatcgtatgttaataaatcaaaatgagatagtaaaattggttaagtgggtatatccaaaattatttgattataaagatattgtcttaagtgatattgatatcaaaattgataattatattcatcttagatctaatttgaattattataatattgaaacaaaagtaaaagcgattgcaaggataagagttgaaaatgaaattattatagattttgatggtgtgattaagtatggatttattaatcttgatttaaacaaggttttaaaagaaatggtaaaagatttatcatatttaacagtgcatgaagaaagtattattattcaaaatgattatattaaagatattaaattaaaagatgagtatttatgtatagaactaaaataatctaatgattattctagttctattttaatgtgataaatttttccccataaataaatttgataaaaatatgccagtaattgaggaccagtcattaattgaccaaaccatgggtatttaaaagatttaccaccagaattgattaaatcgattaattttttataatcaaacaatttaagtaagatattgtctttattttttaacgactcttttaataaatttacaattaaatcacgataaaatggagaatgagttttaggataaggattctttttacgatcataaatatcatttggtaaaaaatctttgaaagcatcacgtagcaaacctttttcaatgttattatgatacatatagtgccatggaacattatatagataagaaacaatatctttgtttgcaaatgggactctaagttcaatggaactacgcattgtttgactatctgaacgtgttaataatgtttgcataaaccattccatattcaaataaatcatttttcttttattttcatcttcaaaagtattatcgtgataatctatttcatttaaagtttgatgatatttatctaaaacatagtctttaatatttaaagcttttatttcatcagagaaaagttccatccgtttatctagttcacgcatccaaggaaaaccttcaatgcttgttagctcttcacgataaaaccaaggatagccaccaaatatttcgtcagcacattcacctgaaagaacaactttatgatgtcgagaaatttcttttgaaaaaagtaaaaaactcgaatcgatatcagccattcctggagcatcacgagcaattaatgattcttttaaagccatgactaattgtttttgcgataaagttacagttgtatgattagtatgataaagcaaacgcatttcatcgatataatgatcatctcttgtagtttgatattcatagggctgaaaatatttttcttgatcttgataatcaacactgtatgttgataatttagaaatgtactggctagcgacaccagtaataatgcttgaatctagaccgcctgaaagcatacaagaaacaggaacatcgcttaataactgctgctgaatactgtgatttacaagacagcgaatatcataaactgtttcttcataattacgattatggttataacgttctaatgcccaataacgattgatttctttgaaaccgttatagacattcatataatgggctggacgtaaactgtagatatctttataaattgttcttccaggagaaacgctaggacctaatcccaacagttcttttatgccggttttatcgacaacacattgttgcaaatacatcaagatacattttatttcgctactaaaaataaatagatcatttttttgataataaaaaagtggttttactcctaattgatctcgtgcaacaaataattttccttgataagaaataacgaaagaaaagattccattaaataaattaaggcatcgcgttccataagctacaaagctggctacaacaacttcagtatcactctgactagtaaaatgaaagccttcattgatcaattgctctttaatttcattcatattataaatttcaccattataaacaatggtatattcaattttattatgagtatatttaaaaggttgtttaccaccgtttatatcaataattgataaacgacaatgtcctagtataacgtgtttgtcattgcaaacattgtaatcatcaggaccacgatactttaataaagaaagcatcttattaaaagttggaacctgatttgataaatcaatattatgattgtacatacataaaaaaccacacatcttaatcaccccgtatattatatgagatgttttttttaatatgccattattggaatacagaatttaaaagatatcgaaagcattaaatactgttgattagttaagtttgcaaaataagttcgtttgttgagttaggaaaataaaaagatgatgagttttgactcatcatctacttaacttttttatcacttactagttcttttaatgaagtagcaagaccggcaactccttgaatttcacttggaataataatttttgtagctgcaccttttgataattcttctaaagccttaaatccttgtaaagttacataagcattatcaggattagcctgattgatatattcgatacctttagcttgagcttcgtatactaatcttaatgcttcggcttcaccttcagctttagcaattgctgcttctttttcagcggttgctcttaagatcatagattctttatcaccttcagcatttaagatagctgctgtttttttaccttcagcttgtaaaatagcttcacgtctttcacgttctgctcgcatctgtttttccattgcttcttgaatatcgcgaggtggaatgatgtttttgacttcgacacgatgtactttaattccccaagggtcagttgcttcatcgagaatactacgcattctagaattaataatatctcttgatgtaagtgtttcatctaattcaagatcaccaataatatttcttaatgttgttgcagtcaaattttcgattgcgttaattggacgatcaacaccataagtaaataatctaggatcagttatttgatagtaaacaactgtgtcgatttgcattgtcacattgtctttagtaattactggttggggtgcaaaatcaacaacctgttcttttaaagaaacacgattagctacatgatcaaaaattggaattaaaatatgcaatccaacattacaagtacgattatatgcaccgatcctttcaactacatacgcttttgattgtgggacgattctaattgttgaagcaatgataaaaattgcaatcaaagcaagaaaaatccataaaataatagtaataataccattcatttttttaacctctctattcctctatttttttgacaactaagtgagctccttcaactgcaagaatctcacaataatcaccttcattaattgttgtattgtcaatacttgatgctaaccatagcgttgacattactttaacttcacctttagtatcagctgtaattgttttagttattaaaccatgtttaccaattactcgatcaaaattggttctttcaatattaccacgcatatattttttagcaatcggtctaacaacaactgcagtgattacggtaacaatgataaataccgctatttgaattgactgatgtattcctaataaacatagaatcaaagcaataatgcctccagcagcaaaccaaatactaactaaatcaatcgtgattatttcaataacgattgcggcaattataatacctaaccatattggtatcattttaattttcccctcctaatttaaagatttactagtaaaatttgatgaattacatcaaatctagcaggatatttaaaacatttattattacttaaatctaatttatattcttttgatagttcgttgataaaatttttatttgatattcgaccataactttttcctattgaaatacgatgcagttgatcttcaggataaatttcttcattcagttcctgtttaccaacaggcttaatgcctaaaatattatttttacgatctaatcctaacaaaacaaaattaacatcttcaaaatgatgacatgcagctttgtttaaagttagattagtactgtatatagtaactgtcttttttgcaatatcattagttgaccactcgaactccatctttatcaccctttctgtttatattatattataaaaattatttttattcaattaaattattaaaataataaaaaatatattataagttcgttcaaaatgtttatcatagcagtatagtagtatagaaatcgtaaaataattaatatttattaaaattattttattgtaattgatacaaataaaaaatacttaaatatgtagtaaaagtaaaaaattagtaaatatattagaattttgattttaaaattagtaaataaaaaatataaatatttacactaaatgtgcaaataattaaaaatatggaaatgttataatgaaaatgtctaatgttggaaggagtattgatatattatttgatatgaattatgttgaaatgtaaaaaaatggtttattaattatttataatttagaagaaaaaataaaaaggataactaccattaattggggaaggtgattaaaaagaatgaaaataaaaaaattattcagtacagtattatcttgttccctaatagtaagtggtctaactgctggtgttaataccgtagaggcaactaatgatagtgttatcacgcaaataagtgatgatgttgtatctattgggaatgattacatttcaagagaattttcgattaaagatagcacgattttaactagttcaattttaaataaacgtatcaataaaagtttagaacctcaaaaaggttcagaagattttgttattaatactcttagtgaaggtaaaactgaggaagatgataataaaataacaaatgatcctgaatgggtttatcctactcctttatctactgatggttggcaggcaacattgaaaaatgcagctgggacagctttttcagcaatccaggtagctactttatttgatggtgatttaaatactaatgttgattattggcaaataagtgggcatccttttacattagatattgattttggaacaacacaaacgattgccggaatgtcagtaaataaacgtccagggtatcgtgatgctgcttatggtatcaatggtactatgggaggttatgaagtttgggtaagtgctgatggtgctgagtatactaaaatagcagaaggagagtttaccgaagaagattataatcttcataaagttggtgatttatacaatgtcggtgatatggtatatgtaaactttgataaagctgtggatactcaatatgtacgagttgttcaaactagtgttgcacttgggactgctcaagaattcacaagcgcagaaattgatttctatgatcaagaaattacaaagacacaaaaagttgttgaaccaactgaagtgttagatcgtagtaattggacaatgacgatcaaaaatgctaatggatctgcttttagtgctgcttctgtagctaaagtaattgatggagacttaaatacatatcctgatgaatatactgtaagtggacatccaattactgttgaaattgatttaggtgaagaacaaactgtacgttcattatcaattgacaagcgtccaggatatcatgatgcagcttatggtactaatggtactatgggtgaatttgaattgtatgttagcgctgatggtgtaaaatggaatttagcaggtgctggtaattttacaagtgaagcttataatttacatgatgcagacggtttacacaatgtaggagatcgtgtctatgcaaacttctataaaccttatacaactagatatgtacgagttgttcaaacaggagttgcttttggtagtgcgcaagaatttacaagtgcagaattaaatctttatactgatcaatattatggaccaaattacaatgttgcagttacaccagtttcagaagatgcaatcgtatctagtgatttagtatatgctggtgctaatgttgaaaacattgaaaatggtaaaaaattaacaatttcatatgaaccatatgaaattaatggtgttacttataacatcgatcaagtagtagtactaacagctggtgatcactacatgcgttcattcttagaaattagtgtaagtgataaggataaagcacaaatcgattacatcgatactgacagatttgtgttaccagaagatgctgaaggtgtttggtcacatcctgatgatagtcaaatttcatcaatgtggattggtcaacatgaattaatgttaggacaaccaatttatgtaaatggtttatttatgggatctgaattcccagcaactgatactattatcaaagataatacgacacaaattcgttattattcaggtaaaacatttacacgtttacaagaagataatcaacttacaacagatggtaagttcgttacttggcagaatgttgttggggctgcacaagggacagatacttcagtagttcaaacagatttctttgaatatattgaggatattgcaacaccaacagattttagaaaacagtataattcatggtatgataatatgatgaatattaccgatgaaagtattgctgattctttctatggagctgaaaaaggattaacagaaaatggtgtagaaccattagattcttatgtagttgatgatggatggaacaattattatgatggtacatacacagcaactccaggaagttctcaaggaactacacctaaccagacaggattctgggaatttaacgctaagttccctaatgaattgtatacatcctcttctttatctaataaattacaatcaacatttggtttatgggtaggacctcaaggtggatataattactttggaacatttgctcgatatttagaatctaaaggaactggatatgtacaatcaaattctgcattaggaaatgttatttgtacaggttctcgtaaatatttaaagaattttgaagaaatggcaatcaattatcaagatcaatttgatattgattattggaaatgggatggttttgcttcaagaccatgtaacaatgctagtcatgatcatatgactggtggcaatcaaaatatgtactttacttctgatatgtgggaagcatggacagatttatttgataatgttcgtgaagctcgtgctaaagaaggaaaaggattatttatcaatgctacatgttatatcaatttaagtccatggttattacaatgggtaaatacaatttgggtacaagattctggagatactggtcaattaggtactggtgaaagacatcaacaaaagatttattatcgtgatcaagtttattatcaattatataaacaaaatcaaattcaattcccattaaagaatatttataaccatgatccaatttatggtgtatcagatggaagtagtgcaactactgaagtgtttagagaattcttattcgctaatgctgttcgtggtacagctttctgggaattatattattcaccatctattatggatgatgctaaatggaaagtaactgctgatgctctagcttgggctgaagaaaatcatgaagtattaaagaacgcgaagttatttggaaataagccaagaaatggtgtgtatggatattctagctggaatggaaatgaaggaattatttcatttacaaatccaactgatgaagaacaaacatattctttacaaataacagacgttgttggtgctaaaacaactttaaaagatgctaagggtgttcaagtttatccttatgctgaaggaaatattgaaaatacactttcttatggtgatacaattacagtcactttagcgccacatcaaacaatcattcaacaatatggacatgttgataatgataaacctgaaattatttctgctaaagcaactggaaataatgaaatcactttaaaattcagtgaaagaattcaaggtggtacttatacagttgctggtaaagaagtaactgctgaattaaaagaagatttcagaactgtggtattaaatacgacaagtcttttgactaatgttaatgcagtttctgtatcaggtgttaaagatttcaataacaatgaattatcacaagatattaatgttgcatactatgaaaatggtgttgtagcaagtgtgtctagtgaaaatgatttaaaagatgctagtggaattgaagcttcttataacgctaatcaagatactgtttggttaagtggtattgatcaagcgtatactgttgatactgaaaataaatttactggaactacagattttagtatcaatttaggtgtggaaacaactgctacaaatgttgatttagttaaattaggtgatgatgtatcattatcgatcgataatgatggttatgtggtatttaaagttaaagatcttactttaagttctaaagaaactgttacaacagttgttgaaaaagcacatggaacatttggtacagatgaatatgttccaacatctacaactactacattaactggaaatgttaatgatggtaagcaacattctattaatgcggttcgtgaagttaatggaatgcttaaaatttatattgatggtaaattgtcaagctcattatatgatgctgatcatttaaatgaagctgttcaaggtggtaatattatcgttggggataatgatttcactggaaaattagcacaagttactgttaaaaatagtgcagttggatatgatgaagtacaagcatttactactgatgtaaatgaaatgattacgccatctcatgaaaactggactgcaacggcatgttcagaagaaactggttctactggtgatgctaatgcaatggctgctattgatgggaatttaaattcatggtggcatactaattatcatggtttagaaacatgtacagataatcactggattgcagttgattttggtggtgctgaaacatttgataaattcttatatactggacgtggagcgtcttctaacggatcaattaaagattatagattagaaattaaagatgctgatggaaattatacagtaattaaagaaggtactttctcaagtgaaactaaagaaaatgttatccaactagatcaaatgtatacagcatatggtattagattgacagcgttatctactcataatggtaataattttgctgcagctgtagaaatcgatgttgctagagatgatacggcagcaacagctgaaaagatcgccgaagtaaaagcaatgattcttgatgatgctaaatcaattaatttagctgattactcaaaagtaactgctgattctttagcttcacttttagcaaaagtagaagtaatggattcagcttctgaaaatgctttagaattattaacagctcaatataattcattaaaagcagctttaattaatgttgctgaacttaatagcgcaattagtgaagcaaataaagttgatgcagatttatatactgctgaatcttatcaagtatttgctgatgcgcttgcaaatgcaaaattggtagcagtaaatgctacaactgctgaagaagtaagtgcagcaaaagatgctttagctagtgcaaaagatgcattagttgaagttgaaccagcgaaaacaaataaagcagcattacaaatagctgtagatacagcaaatattttaaaagctcaaggagctttagataatgttgtaccagcggtagttgatgaatttaatgcagctttagaagaagctcaaactattttagctgatactaatgctagtcaagtaacaattgatgcatcatttacacgtttatcaacagcaattcacatgttagaatttgtaaaaggtgataagactgatctagaagctttgatcgatgtagctgaaaaatatgaagaaggaaattatacaactgattcatgggcagcatttaaagaagctttagatgcagcaaaagatgtaatggctgatgaaaatgccttagaaagtgatgttaatgaagcgttaaataacttaacagaggcaatctcaaacttagtattaagtgctgataaatcaaaattacaagcattatatgataaagtaaatggtttagataagagtctatatacagaagctagtgtagctggattaacagaaccaatggcaaatgctaaagttgtattggataatccagatgcagcacaaacggaagtagatgccgcatatgaagcattgattagagcatacttagacttaagattaattccaaataaggatctattacaagacttaattaatcgagctcaatcattgaacgtggcaaattacagtgctgaaacatggtcagtgatgatggaagcattagaagaagctcaagcagctttaactaatggtgatattgatcaagctggtgtagatgcagcctatgaaaacttaatggctagtatcaatggattagaagtagttaaatcaggagatacaactgctgcaatagatacaggcgatacaacaaacttattatatccacttgcaggacttgcaattgcaactctagcgttctatggaaatagaaaaagaagatatagataaaaaataatttaaaacaagacttacggtgtaggtcttgtttttttgttatataaaatagattaaagaattctaataatttataaaggaatcaatataggaaatgtgagttaaaagaggtataagtatgatgttttttatcttaagttagttagaaaaagctttgatattttgatttaaaaagattaaatttttaaattaatatatggttaattattaataatggcaaaaattagtatttaatttgtcttttttagggcgattattgacaaagataaagatagtgagtaaaattaattaagcgcttacattgtgtgctgatgcaaaattaatgaaaggatggaggaaaatgaaaggtaaaaaactagtaagctttttgttatcatgtttgatggttattgggttgatccaaatttcaccagcatatgcatcgaatgctgaaaatcttgctttaaacaagccggcaacagaatcaagtgtatatcctggttcaagttgggatgcatcaaaagctgttgatggaattgttagtaatgaatcaagatggtcaacaaaaagactaggaactgggacacctgcagaacaatgggattctaattttgagcaatggatgatggttgatttattagaagagtatccaatttctcaaattaatatcaattgggaagcagcaacggctacaaagtatacaattcaaggatctttagatggtgaaaacttctttgatgttttagtatcaggtgctaatgatgcaggaatgcaagaacataaagactttgaagtgtttacagctagatatattcgtattttgtgtcaaacaccaaaaactgcaagatatggatattctatttatgaattagaggtttattctcaacaagtttacaatgctggaagtattattgatgaaatcgaaaaagaaacgccagtattgtcagatgatggacaatcacttgttataccatcagtaccagatggatataaaatttcattatatgggacagataatgaacaagttgtttcaaaaactggaaaagttacgcaaccattagttgatatgccagttaatatcatgtataaggttgaaaatgttgatgatgaaacagatactgccttatcagatgatattgcatttgttgttaatggaaaatatgatgttgaacaacaagacaatgaaaaaccaaatgttgttccaggtcttagagaatggaaaggagcaacaggagattatcagttaacagctacttctcgtatcgttgttttagatgatgaatggttagatagcgctaagatgatccagacatattttaaagatatgttaggacgtgatatcgaagttgtaagtgggcaaccacaaactggagatattgtgttaaaaactggtagtactattgatgaattgggagaagaaggatattatttagatattgctaattatgtaacgatcgaagctcctacttataaagggatgatttatggtggtgcttctattacacaaattctttatcaaaataataacactgctcctaaaggacttgcgagagattatcctcaatatgaagtacgagcaggtatgattgatgtaggaagaatgtatattcctttagaatacttagaagaaatgacagtttatatgtcatggtataagttaaatgaagcacatattcatattaatgattactggggacaatctgggtatagtgctttccgtttagaaagtgaagtttatccatcaatcgtagcatctgatgggtattatacaaaagaagaatacaaacaatatcaaaaagatatgaaaaattatggtattgatattatcactgaaattgatacaccatatcattctgaagcatttagagatattcctggagtccagatgttagctaataaagcaggctatttggatattacaacggaagaggcctacaatgctaatatagcgattattaaaaatttatttgatgaatatttggatggtgatgatccagttattcaaagcgataaattccatatcggtacagatgaatacgataaagcatatggtgaacaaatgcgtaaatggactgatgagcttattaaatatgttaatagtaaaggctatgaaagtcgtgtatgggcctcattaggtaaaaatggatttaacggaacaactccagtaactaatgaagcaactatgaacttatgggctccatattgggctgatgttcaagaaacatatgatgctggatatgatataattaatacatatggtggatggttatacattgttcctgctgcaaatgctggatatccagatcgtatcgatacagaaagattatatgaagaatttgaggtcaataactttaaatctggaagaaatccttctggtgaagcaatcgtgccagtagcgcatccacaaacaaaaggggctgaatttgctttatggaatgatatgacatcatttaaaacgggattttcatggttcgatatttatgatcgtataaaagatgctgtttcaatcgtagctgaaaaaacctggtatggagaagatgaagcagatcaaacatatgaacaatttagagaaagaattgatgctttacaaaataaagttcctaacgcaaatccaggaagatatgtagaaagtaaaacagatcaattagtatcttatgattttgaagatgtaagtgatattgtaacagatttaagtggaaatggttatgatggaactattgtcaatggacaagtaaatgatggacaagttatttttaatggtgatggatatttatcattaccaatggatagtataggttatccttatactgtatttatgaaatttaatttaagtgaagttactgaaaatacaactttatttactggtaaagatggaacattctttgctgatatgaatggaaaacttggttattcacgtgatcaatattcatttacatttgattatactttagaagcagataaagatattgatttagttttagcttgcaataacaaagatttgacattgtatattaacggaaagaagattggaaatggtaagttaacaaatacaacgattgcaggaaaaacacaacaaagctcaacgtttgttcttccagttgaaaaagtatttgaaaatgcaacaggaacattgtcaagtatatctgtgtataataaggcaatgacaacagaagaaattgctgatattttaggatataaatcagaaaactatgcattaaatagacctgtttcagtatcaggattagaagtaaatgatggacgttttactgctgataaagcagttgatggtcttgtaagtaaagaatcacgtgtttcatttgctaaagataaagatgaacaatggttattagtagatttagaagaaacaagagttatcgatgaaatcaatattcgctatgaatcagctgttgataaatatgaaattcaagtttctgaagatggtgtagaatttacaacagtttatgttaaagatgaaacaacggctaataatggacctgaaattgatgaggttatcaattttgatgcagttgaagctcgttatgtaaaatatattcaaaaacaaagatggcgtcatactggaaatggacaatggtatagtggaagtatttatgaatttgaagtttacggaccattagaaacagaattgaagccagcaagtgatgctttgattgcaaaagcacctaacagtgccggagcagtttcagcaaatagagaaattggaccaagtacaacatatttagttgatgtagaatttgatatggtgacaactcttgcaccagatcaaacaaatactgctgtaggacttggtaatagtggttcaaattatacagcttatggacaagttccggttattatccgtatgtaccaaggtacttttggtgcttataatggtaataaaggttatgttcaaagtacagttaaatatgagcaaaatgttaaatatcatattagaattgaagttaatttaaaagaaggtacttatagtgcgtatgtaacagtgccaggtggtgaggaagttgcatttgctgaaaattatggttatcgtagttcggctgccgctccttcaaatatcggtaagatatatttattcaataacgaacgtccagaagcaagttattggatcgatagaattagtttaaaagatgtagctgatacagatacatcagcagtttatgatcgtatttcagaattagaaaaattattaacaggatcaatcaatactgaagcaaaaatgacagcattacaagaagttattgatgatgttaaggctaaagctgatgattatacattaaaagatgaaaatcatgcagctttagatgaagcctatgattcatttatgacaaaagaagaaggtaaagtcagaattggttcatataatatcgctgcaaataaaaatcctgatgttgacaaaattcgtgaacaattagaaaaatatgatgttgatatagcaggtatccaggaagttgataagtatacaagtagaaataactatgatatgcttgcagggttcaaaggtgatgtctatggtaatattttcttcagtaaagctattgactatgctggtggtgaatatggtattggtacagtatcaaaatcaccattaaatgatggatcatcagctatgttggaaagtgctggtaatgaacaacgtatctatcaacgcagtgttgtggaattagctggacataaagttgctttctataatactcatttatcttatgaagatacagaactacgtcatcaacaaatgaagacattaaaagcagcgatggatgctgatccattatcatatcgaattgttgtaggggatttcaatgcagatcaatatcgagaagaatttgctgaaatctttggtgataactataatatagctaatggtatgaatgatattttcttcgatacatttaatggtgtagatgctacaatgaatgtaaattgtgtagataatataatcgtatcaaaaaatattgatattgaagtagtacaaatgattgataatagattatcagatcataatatgttctttgcagatatcacttttaaagctgagcttgatacagataaaacagcattacaaatagcggtagatactgcaaatacattaaaagctcaaggggcattggataatgtcgtaccagctgtagcagctgaatttgaagccgctttacaagaagcagcagatgttttagtagacactggtgctgaccaaactacagttgacagtgctttctatcgtttagctaatgcaattcatatgttggaatttgtaaaaggtgataagagcgctttagaagccttgatcaatgaagctgaaaaatatgaagaaggaaattatacgactgattcatggacagcatttaaagaagccttagatgcagctagagatgtcatgaatgatgaaaatgctttagaaagtgatgttaacaaagcgttaaataacttaacagaagcaattggaaacttagtcttaagaacagataaaacaagattacaagaagcatatgacaaagtagatggcttagataagagtctatatactgaaaacagtgtagcgggattagttgacccaatggcagctgctaaggctgtattagatgatccagatgcaacacaagctgaggtagatgccgcatatgaagcattgatcagagcatacttagacttgagattaattccaaataaggatctattacaaggattgatcaataaagctgagacattaaatgccacaaattacagtgctaagacatggtcagtaatgatggaagcgctaaatgaagcaaaagcaacattagctgatccagaagcaacacaggaagaagtagataatgctaaagaagtattaacgaaagcaatggctggattagaaatgattgaagcaagtaatccagtaaaagctggtgatacaacagcaagtgtagctactggagatacgacaaatatgttatatccacttgcaggactagcaattgctgctctagcgttctatggaactaagaaaaagaaagaagactaatgattttaaaagggaaatagtttgaaatagctatttcctttttttgtgataaaagtgttatatttgggacttaataatgattagtatacttttatggatttttggtttataataaagcaagaggtggaatatgaaaaaaatagttaagttgtttattgttatgatattatgttttagttttgttgggtgtcagaaaaaggaaaaaaatgtatatactgaaacatacacattaaaatatttttatgttgaaggatgctcaaattgtgaatatgttactaataatgttttgccactagttgaagaagagtttggtgaacatatgaaaataatcaagtatgatatggacgatcgcgaaagtgttgaagaagttaaaactgcatatgatgaaattgttgataaaattattgattttgatcaagatgattatggtttcggcccttttttagtgctggatggttattatgctcaattaggagctgacgatgctgagaagtttttagataatctgattttggctgtaaatggtaagaaattgaatgaacctgagggtagtgaaacatattattattttaaagatggtaaaatcaaggaggaataacaatggctacaccgcataatcaagctttaatgggtgaaattgcaaaaactgttttgatgccaggtgatccgcttagggcaaagtttttagcaaaaacctatttacaagatgtaaaacagtttaatagtgttagaaatatgtttggatatacagggacatataaggggaaaaaagtttctattatgggctctgggatgggaatgccatcaattgggatttacagttatgaattatttagccattatggtgtagagaatattattaggattggatcatgtggttcttttaaagaggcagtgcgattacgtgatattattattgttcaaggttgctgtacggattcaaattttgctcaccaatatgaattgccaggtacttatagtgcgataagtgattatgggttattagaaaatgcagtaaataaagctaaagaaaaagatgttaattatcacgtgggaaatattttatcatcagatatcttttatcatgctgatcagaaaacggcagataagtgggcgtcgatgggttgtttaggtgttgaaatggagtcttatgcattgtttgcgacagctgcatatttaaataaaaaggcgctaactttattgactgtttctgattcattagtatctaacgaacaaactagtgctgaagaacgtgaaaaaagttttacggcaatgatggaaattgcattggagattgcttgatgaaacagaagtttgctttttttgattttgatgatacattaattcatggtgattctggtaaagcgttattgaaatattatatcaaaaaacatcctttggctgtttttagattgttaaagatcgtagttttatttcctttgtatttaataggaattgtaaagtttcagacagttaaatcatcgtggctatttcctatggatcatttaaatgatgatgaaatcaatgagttttatcaaacgtgtctagttcctaaatattattcaaatgttattgcggaattgaaaaataaaaagcgtgaaggttataaagtctatatttgttcagcttcgattgaaggatatcttcgtttttgtgacttaccagttgatggtattttaggaactaaaacagaagttgttaatggtaaatatactagtaaaatgattggtaagaattgtaaaaatgaagaaaaagtagttcgattaaatagggttattaaacaattgaatctagtaatcgattatgaaaattcatatgcttattcagattctgtccacgatattccaatgttaaaaatggttaaaaacagagtaaaaataaataaaaaaaatggagaaatgaccccatttattattgaagagtaggaaactgctctttattttgtatctaaatctacaaataataacatgatgttgataataccagcaatacctactaatatatagatcaacattgataaaaaactatcaacaccaaataacgaatctactaggttgaaattgaataaaccaatcaacccccaatttagtgcaccaataattgttagtattaaggaaattttttgtattatattcattattttcatcctccttattaaagtgtatccaagataaataactttatacataatattaaaatttaaacatatttattaatgggggtgtaattttgaaaaaaatatatattggaattgcagttgctattgcattagttgtggcatcactaatattttttaaatttaaagatagctctttagataagaccgttgaaaaagtaaaagcttatgataaatatacacttacatgtaatatggaaatggtagaaaatgatgaattgaaaagttatttggtcaatgtaagctattttaaagaaaagaaggatgagtattataaagtagaactttatgataaatcgttaaatcaatcacaaattattgtaaagaatcttgatggcgtatttgtgttaacaccaacattaaatcaaatttttaaatttcaaagtgaatggcctaataattcccctaaaccatatatttatcaatctttgattgaattattagaaaaaggcgaagtagaaaaaataaaaacaggttatcaggtaaaatgtgatgttacttatcctaacgattcgagaataactagccaagaaatgatttttgataaagaattggtgcctaaacaagttactgtgttagataaagatgataccgaaattataactgcaaatttcacagattttaaaacggaggttaaattaagtaaagatagttttgatgagaaaaaagttcttgaaaaaagtacaagtgaatattcaaatgtatcaagtgaattgcctctatatccgattgctttgatgggaagttctttaaatagtgaaaaagtatctacgattgatggtaccgttaatcacattttaaaatttactggagataagaattttacagttattgaaacaccagtagtagcaactgatgagatcaatattgaagaaattagtggtgaagttattgatcttgttgatggtgtggcgttttataatgaaggacaattaacaatgatgaaatcaggaattttatgtaagttatattcagaagatttgagtaaggaagaaatggtaagtgttattagtagtatgcaaacatctagtttgaaataggggcttagcctctatctacataattattaaaattatttaagagttaattgaaatattataatgtttggattatactaagacagtatggagggtttgtatgagtttacatcgtgatacatatgctgttattaatttaaagtacttaaaagaaaatatagagctgacttataaaaagtttaaacgtcctttaatggctgtgatcaaggcggatgcttatggtcatggatataaggaagttgctagttatataaaggatattgattatattgaaatgtttgctgtagcgacattaccagaagcgattgaacttcgcgaattagggataaaaaaaggaattttgatattgggtgctgttccgactactaaagaagaaattgaattagcaattagttatgatatttctttaacaatgatttctttagattacatgcatcatttacaaacattgattgatgatcagccgttaaagattcatattaagttagataccggaatgcatcgtattggtttgacaagcaaagatgagttagatgagttgttgaaaacgatcgatcatgataaatttattttagaaggaatttttactcattatgctacagctgatggggaaatggaggctttcaaacagcagcaggaaatgttttatgatttgatcgatccaactgaatttaagtatatacattgttgtaatagtgcggcaatgatatatcatcaagataatggttctaatttaggaagaattggaatcgtgatgtatggagttgatcctgctggagatgaatcgaatgaatataaacaagtgatgtctttgttttcaaaagtttcaatggtaaaaaaagtcaaagctggtgaacgaattggttatggtttaacttatactgctaaacaggatgaatttattgctactttgccaattggttatgctgatggattaattagaaaaaatcaggggcgaaaagtctatatcaatgattcttattttgaaatcgtaggaagagtatgtatggatcagacaatggtaagagttgatgaaagggtaaaagcgggagataaagttgaaatttttggtgaacatattagtctcgctagtatggctaaagatttggaaacgatcccttatgaaataatttgtttaatatcaaaaagagtagaacgtttatatataaaataaaaatcagcattagctgatttttatttaaataattgagcaagtcgataatatgataatgctcctgttttatttttagataccttgccatctttatatactattgtttgaggcactgttccatctgtgatgtcaagcttttcttctaaccaggtagtgtaatcactatcgctagagatatcaacatagtataaagatttaccacggtgtttttctaaatatgtagtcattgtatcttgataagataatgttgcactatcgctattattcccgattactactacaaaactatctttatcttctactttttctacaagtgcactttgagtgattgttgtaaattcaacgtgagtaatttttcgataaacgaataacccaagaaaaactacgattacaattccaaagatgctaatttctttccataatttttttactttttccatgattagcctccataacagtacttttatataataccaaaaaaattgtctaaaaacaatatttaaaaaaggatatcgattaatcacataatcttttttattgttgatcgtgttaaaaatactaaaaaaatgctttttatttttgcgttttgtttaaaacattatataaaaataaaaaccagaagcaatattttgcttctggtatgttttgttagtaaattatttatgttttaaagcatagttccaagtatcgcggcacatatcttcaattccttttgtagccacccagtctaattcttctttagctcgagaagggtcggcataacaaattgcaatatctccaggacgacgatcttttattttataatttacttttacattgtttactttttcaaatgtttttactaaatcaagtacactataaccagttccggtaccaagattacaaatatgaacgcctggtttacgataacgttcaatcgctttaacatgtcctttggctaagtctactacatgaatataatcacgaacacctgtaccgtcaggagtatcgtaatcatcaccgaaaacaccaagacattctagttcacctgttgctactttcatgatataaggcattaaattgtttggaatacctttaggatcttcaccaattaatcctgattcatgagctccgatagggttaaagtaacgtaataaagttactgacatttcaggacaagcatgttgtacatctgttaatattctttccatcattgctttacttgtaccatatggattagtagtgtctcctaatttgcaatcctcagttattggaacaacttcgggatctccatatactgtagcgcttgatgaaaagacgatttgattaacgtgatattttttcatcatcttgctgacaatcaatgtcgtagttaaattgtttgtataatactctataggtttttctactgattcaccaacagctttaaacgcagcacaatgaataaccgcatctattttattttctttaaaaactgcttcagttttagcttcatctaatatattaaattcatagaattttacttcttttccagtgatttctttaatatatcccaaaacttcaggttttgaattagaaaaatcatcaattactattacattgtaatcagcatttaataattcaacacaaatatgacttccaatatagcctgctccaccacaaacaagtacattcattattttttcctcctatatatgcttctataataacacttttagatactaaattaaagaaaagtattttttattttgtgtaaaatataggtaatggtaatgaaaggttgaagataatattttaataattaataaagtaattatataatattggtcggttgaaatataaaaaggaagaatttattttattgatggatcaataatttaaaatcttccttataaagagagaaataaagatttaaatatctctcgttatcttatttgttgataattctttttgtgatattatcaggggcaaactcataatctaaaaattccatttcaaagataccttgaccttgagttatagaacgtaaatcaacagcatagttcataacttcattcataggcgcttcagcaacgattttaattaaaccgtcatctaagacatcactaccgattacacgagctcgtttggtattgaaattactcattatatcgcctgtatattgttcgtcaacaacaactttcattttcatatatggctcaagtaatgctggactagctttaggaatagcttctttaaaacacattgaagtagctgttttaaaagccatttctgatgagtcgacattatgataagaaccatctatcaaagtagctttgattccaagtactggatatcctgctaaaacaccacttttgacactttcgatcaatcctttttcgacagcagggagatatgattttggaacagcaccaccaaatattttttcttcaaatacatatgctttgctatagtcataagtaggttcaaatgtaatttcaacttcaccgaattgaccatgaccacctgattgttttttgaatcttgttctttgggtaatgctcttttttattgtttcgcgataaggaatcttgatatcttcaagagttgcttcaactttgaatttgttttttagttttgttaataaaatatctaaatgaatgtcaccaacaccataaatgcactgctgtttagtttctgcatttgatttaaattgtaaagtcggatcttcctctaatagtttattgatagcgttagtgattttttcttcgttgcttttaccgattggaacgattgctttaccatagtaaggtgttgaaaattttatttctggtacgatgatttgatatccagcaatacataaagtatcatttgtttttgaagcatttagctttgttactactccgatatcgccagcgtgtaaacagtcaacttcaattaattctttaccgcaaggctggtatagtttagcgattcgttcaacttcttttcttttgacattatatagagaagttccgctatatatagttccggtaacaactttaaataaagatgtacgtccaacaaaagggtctgcaactgttttgaaaataaagatgctggcaggtaaactttcatcatagccaataatttcctcttcatttttatcaatattattaacgatcaaagaattagtcatatctccagcagcgctgaagaaagctaccatcgaatttaaaatgatttgaattccaatttgatcagttccgcataagactggaatcaaagttttttcaataacaccttttcgtaaagctaaggaaatttcttcttttgtaaatggttcttcattaatatatttttctaataattcatcgctagtatttgctactgcctcatcgatcatatctttgattggctggatctcatccaataattcctcgggaatatccaccggttttgtctgtgttccttcaaaaatacgaccttccatttttgcaacattaacataaccgatcattttattattattcatgataggaacctgaataggagcaatagctttaccataagtatcttttaattgctgtaatttagttgtataatcactattagggttatctaatccgttgatataaatgatttttgctttatctttggctttatacatagcctgtttagttccagcgttgatacctgaagatgatggaacaacaattaaagcagattcacatacactcaaggcagattcgcattcgcctgtaaagtcaaaaataccaggaacatcgatcaagttgattttgcaattgttccattcgatagggacaacagatagattgacagatgatttacgattgatttcttcaatactataatcacttaatgtatttccatcattaacgttgccaatacggttaattagaccgctccggtaagccatagcttcaacaatacttgttttaccacaaccagaatgccctaaaacagctacgttaccgatttcatttgcatgataagttctcattaaaataaccacctttctttaaatgaacttcttaattttattttaacatatatgagtagaaaaaaggattaatttaataataaaagataacgcttacattaatatgtgaaaataatgaggaaaaaagtaattttcatattgattaataactaaaattatgttagtataaatcttgcctaaatcatgagatatcgattagattaaataaagggtagaaaaacaaaaaaagtgttgacctttgtttgaaatgatgatatattaatgaggtagcatttatggaggtttagctcagttgggagagcatctgccttacaagcagagggtcagcggttcgagcccgttaacctccaccataaaaataaataagccggcttagctcaactggtagagcaactgacttgtaatcagtaggttgagggttcaagtcctttagccggcaccatgatggaggagtagcgaagtggctaaacgcggctgactgtaactcagttcctttggttcggtggttcgaatccgccctcctccaccatctaattggggtatagccaagcggtaaggcaacagactttgactctgtcatctccctggttcgaatccaggtaccccagccaagatgacccgctagctcagccggtagagcatctgacttttaatcagagggtcaggcgttcgaatcgcctgcgggtcaccatctcttaatatttgcccaggtggcgaaactggtagacgcacaggacttaaaatcctgcggaccttaaaatccgtgccggttcgattccggccctgggcaccattctcgcgggtgtagttcaatggtagaacttcagccttccaagctgactacgtgggttcgattcccatcacccgctccatagtttgaaagataattagagtttcttttaaagaaactctttttgttttaataactaaatataattttttgttgggttatatcattacattcattgaaggcagaataaaatatttatagataaaagtatcaaagtaattaaggttctatagtttcgctattgaaaataaagatgctttttattttgctttaaatttaaatattgatatgatcttgacattaactttattaaatgatcttttttaatggagaagattttgttataaattgttatgttttgatgtaaaaatgatgcaattacgttgtatgattagaggggtgaatacatatgaataaaattttgattatcgaagatgaaaaagcaatcaatgaattgattaggataagtttaagtgatgcgggatatttatgtaaatgtgcttatgatggtttgcaaggggcggatttgatagaaaaagaatcttttgatttgattttgttagatattatgctgccaaaaattgatggatatgaattgatggaatatatttatcccttaaatattccggttatttttttaactgcaaaagccgatgtaaaagatcgggttaaaggactcaaaatgggtgctgaagactatatcgttaagccgtttgaaattatcgaacttttagctcgtgttgaaaccgtactgagaagatttgataagatatctcgttatttatcggtttatgatgttagtgtggatacactgtctcgaattgtaaagaaggggaatcaggttattaatttaacggttaaagaatatgagttattgctgctttttttgcaaaataagaatatcgctttatttagagatcgcatatatgaattgatttggcaggaaaattatcgtggtgatagtcgtactgtcgatttacatgttcagcggttacgtaaaaaaattgggttagaagataagattgtttcggtgtataaaataggttatcgcttggaggttgacgagtgaagtttttttggaaattgtatttagtaattatgctgatggttgtttcttgttttagtgcgggtggatatatgctgattgaatcaggatttaattcttcactgcgacgtgaagtggagatggcgtatcaggaaaataatattttatattcatcttttacaagggaattattatcgccgtttaatggttataatgcaagtgcttttactgatgcggaaaagattgagattattcatgaatctataacaacattaacgattcaaagttttaatgggacgatctcattttgtttgcggaataatgaggggcagatgatatatcaaaacggaggctttactaatgattctagtttaataaaaaaagtggactcgggaactcgaggatataagatcgttgaagacgataataaatataaaattcatgtgttaagaaaacttgatattgaagatagtgatgtttatttagaaaattgccgtgatatttcatctttatttgagggaagaaaagatcagtatcgaagttttttatatagtattggactgttgtttttagttggaacggtagtgatttttattgtaacaagatggctggtaaaaccaattaaaacattatcacaggcgactaaacaaattacggcagatggtggtttgggtgatgaaataaaggttcgtagtaatgatgagatagggcaattaacgagagattttaatataatgatgaagcgcttaatgacatcgatggaagaattgcaggatgctttaaagcgtcaggaaattttcgttggaaattttgcgcatgaattaaaaacgccattaacgtcaatgattggttatggtgacatgcttagaagtaaaaaaaatactgaggaacagatcataagttatgctgatttaattgttcaagaaggtaaaagacttgaaaaaatgtcaatgaaattaatggaattaattgtattaaaaaagcaggattttgtttttgaaagaattaatgctagtgatttttttggagaaataagtgcggttgttgctccggtgatgaaaaattcaaaagttgattttaaagttatggttgcagatggagaaatcattggtgaacgggatttgttgaagacagtttgtttaaatttactagataatgctcgtaaagcaatagaaaatgaagggttaattaagtttttgggagtgaaagatgataatggttataaaattataattgaagataatggttgtgggatcgaggataaagaagttgataaaattaaagaagcgttttatatggtagataagtcgcgttctcgtaaggcaggaggcgctggtttaggattagcgatatgtgatcagattattaaaatccaccaaggtgaaattgtgattgaaagtattaaaggacaaggtactaaggtgacggttttatttaaaggcggtgagattcatgaagaaagttaaaacttttttgatagtactgactacaattgctttattggtgatcgtggcttttatgccgatcgtgctggctaaatggaatgatgaaaggatgttggcgagtgtggtaatagataaggttgaagataacgatagttcgatgatacatccaagtaagttgagtgtgaaggaaaaaatagctttattgtatgattataattataaaaatcaaaagtttgttcttgtaagtcaacaacaaactaaatctaaagaagagtttgaaaagataaaagaaagtgtgataaaagaagtaaaagaactgcaggatttaaagatactgccagagtttaattttaatgataatcaaaaagaatatacgattgaaatattaacatatgctgaaatgacagatcctgaaagttgtgtcgttgtgatgcagatgggattttatgatgataagagtagtttgagcatttggtttgatggaaatgatagtactatttatcgctgtagttattatggtgaaaatttagttgattttgaagcaactggtatttttgatgaaaatgttttgcttaattatggaataaactatttaggattgtctgaagaggaaatgatgaaatattgtacggttatggctagtaaaaaaagaattgatatcggaattattaattgatgcagttttgattcaaaaatgtggcagtttttatgttagtcttttatatgatttaagaaggaggtgtgaatgtgaaaaaaatagtgatttgtctggtggttattattggatatattataggttttaattattttattagagaaaatagtagtaaaaataacgtattaaaaacaagggcgattgaagaaaaacaaataataaatgatgagttgttaacgctggttaattataaaaataaaattcctgatgattggaaagttgatttggtttctttaaatgatcaacaatcaattgatcaacgtgcttatcaagaattgaaaaatatgctgaatgatgctaaaaagcaggggttaaacataatagtatgttcatcttatcgtacatatgataaacaaaaagaactttttgtaaataaagttaaagagtatttaaaggaaggttatggttataacgaagctcaagaggctgctagtatgtgggtagctaagcctaatacaagtgaacatcagttgggattggcagttgacttggtttctaagaaaaatcaaaggttagatgatagtcaggaaagaactgctgaacaacaatggctgattaaaaattgttggcgatatggttttattttacgctatccatcaaataaaagtgatttgacaaaagttggttgtgaaccatggcattatcgttttgtaggaaaggaacacgcaaaaaagatcacagagcagggtgtatgtttggaggaatatctgaataatttgtcaaatggttaaaagtttatataaaattcacatcagtgtataatattatatatgtgaggtgaaaaaatgactaagagatttgagtttgatgacaatgatttaaatgcaacagattttgaattagattccaaagcgacagatgaagatgatttagaagatgctactacagatgctgcgacaaataaaggtcgtcaaaaaactaagaaaaagaaagtaaccaaaacaaaacgtaagactaaaacgaaagtaaaaaaagaaaaagaaggacgttctgttttttcaacggtattattatttttattgattttagtaattattactggtggttgtgtaggtgcatattttgcatatgaatattatcaggatcaacaaaatcaaatagatgatcttcaagaacagattgataatacaaaaaaagaaaataataattcaagagaaaatagtgattcaaaagaaagtgatgaaacaaaaaaagatgtaaataaagatgatgatcagagttctgatgaaaataaaacagatgaatcgactaatgaatcaactgatgatttaccagaagatgaaaatccttctagtaatggtgatcaagtagaagaaaatgaataaaacacgattatgatatgatctaaattagtagatagtataaaaatacagtttattaaggaggatcgtatcattatattagtgttttttcttttaatgttttgaattgtagaaaaaatgtaaaaaaaattaaaaaaagacttgcaatagttaatattaaatgttattatagacgagcagtagtcgttaggggtgctgctaagaagaaaatgcgggtgtagttcaatggtagaacttcagccttccaagctgactacgtgggttcgattcccatcacccgctccattgcttgaatagctcagttggtagagcaatcggctgttaaccgatcggtcgtaggttcgagtcctacttcaagcgccatggcctgttggagaaacggttaactcacatgcctttcacgcatgcattcacgggttcgaatcccgtacaggtcaccaattgtaaattagtccagaatcaatttctggattttttattttataaaaaaatatcactaataattattttgttagtgatatatgaataagaccgatactttgattaattagatttccggctatatattttaataatgtagtttggttattgggaaatttactgttatgagaattgatgtgaaacattcgatatgaattttcgatatagtttaatagccataatattgattcttgaaaattaccatgaaatacaggcttttcaataagtgggaaaaaactggtagtatttatatcttggtaaaaatgatcaagataaatagcattatttttgcaatcagctgaaaaattgtgaagtctgatttttgtgatttcatctggagcgatagttaagatcaaatcgtatatagctgcaagataaagctgattataaatcaaagtttctataagtgaagtatccatataattttacgttcctttctttacgatataagtagatgtttggctttgactataagaagtcaaagctttttatatctaatacagtctatgcatttttgatgaaaaaatgtttatagttttagttattgatcttaagctctaaattagtaaagtgtataatgactagaactatgatatactaagtgataaaatagtatttaaatttataatagtcgaggtgatattaatgtcttatcaaattattaaagcttttgtatatgttatttcggtcatgctttcgatgtgggggctaagttgttttaattttgataatgtaattagaaaagctaaattacgtgaattttatttgttctttttgattgcatcattagctttgggatatttattgggttcttttattttggagtttgcgacaattcatttttaacatattttaaataactgtacatataattatgtgaggtaattatatgaaagagataagtgtaaaattaggaattgttgtattggtaggaatcatttttttatcaatgaattattatcaggttaaagaagaagtgattcagggtaaaaaagaggaagctgtaaaagtagcagtaacaattgatgacaatgttaattatgtggatttagatgactatcttttaggcgttgttgctggtgaaatgcctgctaattttgaattggaagcattgaaggcacaagttgtagctagtcgaacttttgtttataatcgaaatttaagtgtcgataatactgttaatagtcaagtttatttaagtgaagatgagatgaaaaaaaattggggtgataagtataatgagtatcaccaaaaaattagtgaggcaattaaagaaactgataatgaagtaatgaaatatcagggcgaatatatttcggcgttatttttttcttctagtaatggctatactgaaaatgtagaagattattttgaatctagtcccttaccttatctaagaagtgttgatagtcattgggatttaacgatcgatcctaaaaatacaagacaaactacatttacaaaacaggaactaaaagaaaaatttaattgtcaagatttgaattttaatataattgcatataaaaaaagtggtcgtgtagctactttaagtgttgatggtaaaaattacagtggtcggcaggtcagagaaatattgggactgtcttcaagctgttttacgattgaatatgtcaacaataattatgtttttacaactaaaggaagcggccatggagttggaatgagtcagtatggtgctcaaggaatggctttagaaggctcaaattataaagagattttgaatcattattatacaggtatcgaaattgtaaataattagtataaaccttattttagtggaaacactacaaatgaggtgaaataatgaaattatttatgaaacgtaatcgacgtgttttagtatttagtgtggtagtaatgctgtttttagctggtgttgggatagttcagctggttatgaatcaatatcagccgtttaaagatactgctgttgtaaaagtagaagataataaagaagaagataaaagtgaagaagatcagccaactgtagcaacagagaaattgatcaaacctgttgatgatgatgtaacgattgtaaaaaaattttatgatgcatccttaagtgatacagaattagaaaaagcattagtgtattttgaaggagtatatcgacctaacttgggagtagatttttctaaagatggaaagacgtttgaagttaaggcggcatgttcaggtacggtaactaaaaaagataatgatgctttacttggttggattgtaactgtaactaatgaaaatggctttagtaccacatatcagtcattgagtgaagttagtgttgaaaaggatacggttattaagcaaggtgacaaaattggggtcagtggtgaaaatgtttatgaatcggaattaaagaatcacttgcactttattttagaaaaagataatcaagctttgaatccggaatcttattttgatcaagaagtcacaaaaatagcggtataatcaaccaaatggcaataataaaaaaattattgctatttggttttattttgttttttaccttgtaaatatcaaaaatcatggtacaatagttaagaaaaataaggaggactaatgatggcattatcaaaagaaataggtatcgacttaggtacagcaaatattttaatttatgtcaagggtgaaggtatcgttgtaaatgaaccttctgtagtagcgatagatgatgaaacaaaaaaacctttagctgttggccaagaagctaaagatatgttaggtaaaacacctggaagagtaaaagcgattcgtcctttaaaagatggagttattgcggattttagaattactgaaatcttaattactcattttattaataaattaaatttaaaaggaattttttcaagaccaacaattctaatttgttgcccatcaaatattacatcaattgaaaaaagtgcaattaaagatgttgctgaaagatgtggtgctaaacgtgtcttcattgaagaagaacctaaagtggcagcagttggagctggattagaaatttcaaaacctacaggtaacatggtaattgatattggtggtggaactactgatattgcggtattgtctttaggtgatattgttactagtagttcacttaaaattgctggtgatgttatggatgaagatattattaaatttgtaaaagataaatataaattattgattggtgatcgtactgctgaacaaattaaaatgcaaattggtacagcaatcaaaggaatcagtgaagaaatcttcgaagtaagaggtcgtgatttagtaacaggattacctcatacaattacaattactgctgatgaaacagaattagctctaagagagacttgtcaaactattgtaagagaaacaaaacatgtcctagaacaaacaccaccagaattagcagctgatattgtatctagaggaattttcttaacaggtggcggagctttattaagcggacttgatcgtttattagaaaatgaattaggagtacctgtatttgtagctgatgatgcattaaattgtgttgctaatggttgtggggttatgttagaaaatacacattatgtaaaataatacatgagatgaaaatctcatgttttttttaaaaataaataattttaaaatcgtattgactttaccgttaggtcaaggtgtacagtagtgttaaagatgtttgaaaggaggaatgactatgctgactattggggaattttcaaatatatgcaaagtttcaacaaaaacgcttcgatactatgcaaaaattgggttgcttttgcctgataagatcagtccggaaaatggctatagatattattctattgatcaattggaaacgatgttatttattgaacgtttaaaatcttataatttttctttggaagaaatcaaagtaattcttaatttaggcaaattacaaaacgagaagctttatgcagcgcttgcaagaaagaaaaaagaagttaaagaacaaatagataaatctaatactattttagagagattaaatgaagatatgctatgtttacaacaagggaggtcaattatgtcgtatttagaagattttgatatcgaattggttgaagtaccagagatggatcttatttcgattcgtaaaatagttcgtgaagatgaatttgttgaagcgtatagtagttgttttggcgaattgttgaagcggatccaaaccaataatttaaatgtttttgccccgccgatggtactatttcatgatgcagaatttggggcacttggtttagataccgagtttgcaattcctgtaaaagaaaaaactattgatactagagaattttgtccgggattatgtttgaaaacagttttacagggttcatattcaaatttaccatctatatatgctaaacatcgaaaatggatggaagatgagggatatgtgtatcgagacgcactttttgaagtatatgtaacagacccttcgtgtgtttcaaaagaaagtgaacttgtaacagaaatatattccccagtaaaaaaaggtcaataaaaatattttttatttggattatttaagacgctcttgttaaatgacgggagcgtttttttagatgcttgaacaacaatatcagactaaatgatttatttatcttgtattttagggtaaaataattgataatatacaagagataggaagtgataagatgaaacctagtttaataatgtcttttgttgttacaatgatgatttctgctttgttaattcctatagttattaaggtgggaaaaaaattaggaatcgtagcacataaaaataaacgaactgttcataaaatcgaggttccacgtattggcggttatgcaatttatatcagctctttaataggtgcggttatttttttaaaaactgatccacaaataaatgcaattttaattgcaggatttttagttttttttgttgggcttttggatgatgttcatgatttgtcaccaaaaactaaattaatagttgaactagctgcggctttaattgtgattggatatggaaatatttatttaaaaggctttgattttgtacctgaaaactgggtaccgataattcccggaatgattacagttttatggatcgttgggataaccaatgccatcaatttaatcgatggtcttgatggtttatcatcagggatctcaatcattgttttatttactatatcaatgacatcattgactagtggcagaactgatattgcatcactttcattagttttagcaggttcgatcatgggatttttattttataattttcatccagctaaggtttttttaggagattgtggtgctttgtatattggttttatgatctctgttatctctttgctggggtttggttataatgtctctactttttttacattgggagctccgatagttgtattaatggttccaatcatggatactttaattgcgattattcgtagaaaagtgcatcataaaaagtttagtgaggctgataaagcacatttgcatcataatttaatgtttaaattaaagctgggacatcgtaaaagtgtaattgtactttatggggtaacattcttattttcgttaacatcatacatatatttatacgatccaactttaggaacgattatgtttattattttaatgcttatttttgaattgtttgtagaaatgacaaacatggtcagtcgtaaatataaacctttgcttactataattaatatttttgtgcagagtgatcatttaccaaagatcaagatattggaacgctatagatctaaaagatctaaaaagagagccgttattgatcagctggtcatgattagctgcttgttattaattattggtggtagtgtaacgtatattcatttaaatcaagaaaaacctattattaaagagcagcgagttacaccatatcttaaaactggatctagtgagttgctgaatgatatttatgtaagattagataaagcttatcaaagtaaacttttaaatgatgaatgtcagctggctgcagcgtattttgccgttgattattttactttgaagggtaaagaggataatcaggttgggggattggattatatttatcctaaattacaaagtgagtttaattcatttgcgttgaaatctttttatacatataaagaagaatatccgaaattagaagtagaggattatgaaattatttctttttcgccatctaaagttgttattgaaggattggaggataatgagtattataatgtacttatttctttagagtttaatcgtgaggttgaagggttgtcaaatagtgcaaatattgttttggttttagataatgatcgtttttatgttgtgggggttgacaatgcttaattataaacgaatttttgaggttgatgatgaattgtgtcagtttcatttgaagcaaaagcaatattatttattagagaatgttatcccaactagagattatcttttaaatgatatgaaacttccagaaggctttgatgaaagtaatcattatatttataaagtgtattttaaagataagatgattgctttgatagattttcagttaggatatcgcttttcaatgaaacatgatgataaatgtctttggattggcttgtttttagtagatgaagattatcaaagaaagaaatttggtaaaatgattattgaacattttattgataaatatcaaaaaaaatgttgtttagtgcaattggcttgtataaagaacaatgaaaaaggaatggcattttggaaagctttaggatttaataaaattgctgtttctatgtataataatttagaagttgagatattagagatgaaaatttaatactattagtcaaagtattgactaaatcattgaaattttaaaaatattatgttattatgttttagcgatgtatcaaaatatcaattaggaggtatattatgtttgacaccattttaaatgtcttattagtaataatatcaatagcacttattatattatgtctattacagagtggtaaatctgatgggattgttaatgccttaactggtcaaagttcaaacttatttgctcaacaaaaagatcgtggagcggatttggtaatgacaagagttacgacagggctagcaattgcattcttcattattgccattattattagaatgtcataataataggactattggtcctatttttatttttgtttaaggaggtggatcaatgaaagatgagatcttaacattgttaagtgatgatgattatatggatcgctcgattgatttgttagctaaaagattagattgtttttctagtgaaaattttgttaaattagttaagataatgaacgaattagaagaagcgggaaaagtaataagaaataaatataatcattactatttgccaaatcaatttggaatggttttagggacacttacgatcaacaaaaaaggttatggttttgtagctgttgatgatcaagaaaaagatatttttattgctccagatgcattgaaggatgcttttaatagagatactgtattagtagaaattaataaatatactgatcttgaaagaccggaaggtaaagtgattcgagtcataaaacgaggtcaaactagattagttggggaaataaaaaaaggtaaacgggattattatgtagatgtaaatgatcctaagtttgataaacctatttttgttgatcatgctcatttacatggtgcggttttaggtcacaaagtactagttgaaattaaagtttataaaccaattttaaaaggcgatgttgtaaaaataatcggtcataaaaatgatccaggaattgatattttatcgattgtttatgaacatgatacgcctgtagaatttaataaagcagtttatcaacaaatagaaaacattcctgatactttagatgagattgataaaagtaatcgtattgaccttcgtaatgaaacgatcgttacgattgatggtgatgatgctaaagatttagatgatgctatttcgctaaagaaattagctaatggcaattattatttaggagtacatattgccgatgtgtcatattatgtagaagaaggaactgcactggataaggaagcttttgcccgcggaacgtcgatatatttagctgatcgggttatcccgatgttacctcataagctctcaaatggaatttgttctttaaatcctagtgtcgatcgttttacaatttcatgttttatggaaattaatcatcgtggtgaagttgtcgaccatgaaatcgtgccgggaataattaattctacggaaagaatgacatatacaaacgttaataagatattagatggtgatcaagcattacaattacaatatgatcatgttaaagatttatttttcttaatgcaggaactggctttgattttacaagagaaaaaagctaaacgtggagccattgattttgatgttaaagaagctaaagttgttgtaaatagtaaaggtgaaacgacagatgtggttttaagacaacgcggggctagtgatcggatcattgaagaatttatgttattagcaaatgaaaccgttgctgagcattttaaatggttagaactgccatttatttatcgggtccatgaacagcccaaaactaaaaaactgcaacaatttagcacaatagctaaaattatgggatatacgatcaaaggatcattggaaaatgtttatcctaatgaattaagcagtattattgaagcaagtaaagaaacgccggaacatacgattatttcaactctattgttacgctgtatgcaaaaagcgcgttacgacgaacagtgtttaggacattttgggttagccgatgagttttatacccactttacatcaccaattagacgttatccagatttgatcgtgcatcgtttaattagaaagtatttgtttgaaaaacgtctggatgatcaaacgattagacattatcaggaaataatgccggaaattgctcttcaaagttctaatcgagaacgtgaagctattgatattgaacgtgaagttgatgatatgaaaattgctgaatatatggaaaagcacataggtgaagagtttgagggaattataagttcagttactaattttggtttttttgtcgagcttgataatactattgatggtttagttcatgttagtgatctaactgatgatttttatttctttgatgaaaaaaatcttcgttatattggacaaagaacgggaaaagtgtttaaaatgtctgatcatgtaaaagtaagagtaataagtgcttcgaaagtagataaatcaatagattttgaaattgttggcatgaaatccaacaaaaagacaagaaaaactgttataatgaatacacgtcgagatgataaaaagaaaaaaagtcaatcaagacataaaggaagacatgaaaagtcacgctacaaaagaaatgatttttataaatctcgaagtaaaaaacgtaaacatcattaaataagaaggaggaataggcatgaagatcatttcaaacaacaaaaaagcatatcatgattattttattttggatacatatgaagcaggaattgaactaaaaggaacagaaataaaatctgttcgtttaggaaatgttaatttaaaagatgcttttgtccggatcaaagataatgaagcttatgttgaaaacatgcatatttctccttatagccatgggaatcgctttaatcatgagcctagaagaactagaaaacttcttttacataaaaaagagattttaaaaatctctaataaattaaaagaggggggcttgacagttgtaccaactaagttatactttaatacgggtagtaaagttaaattagaaatcgggcttgctcgtggtaaaaaactttatgataaacgtcaagatttaaaagaaagagattcaaaaagagaaattcaaagagctttaaagaattattgatttgggggtgtcctgggttcgacaggtatatgtctgaccttagctgcagtcgaaggcattcgtaaaatgcaccaaaaaataactggaaacagacaaactaattacgctttcgcttagtcgacatagacatgaaagctgccactgtttagtgtgcctatagctagatagctggtatcataaacccataggataaggatatctatagcttagatagatatttcgaaaatttaataagctcgttaggtggaaaattgcccattgattgtagcctaattaaatttattcaatgggataaactgtagacgctttggagggattgtgcttggacaggggttcgattcccctcacctccaccattaaaaagatgcacgctttttatatttatatgaaaagcgttttaaataaaacgagaaagaggtaggcatatggattatttagattttataaaaataaatcaaaattattttgaagattttattacaagaagtacttatcacacaaattcgatagaaggtagtactctttcatatgcagaaacttatgcgattatttttaatgataattcttttaaaatcaatgcacaacctcgagaaatatatgaagctattaatcataaatatgctttaaattatatgttaaatagtatgatattaaataaggatctaatatctttggatattattaaattaaatgagataatcaataaaaatataaaagatacttcaggatatagaaaagtcaatgtcatgataagaggtgcgcaagaaattccgcctaaaagtagtgaagtgccgataaagatgatgtattttattgataactataatcatttcccaattcaaagtaaagaagatatttttaagaaaatagcttattttcatattgaatttgaacatattcatccttttgaagatggaaatgggagaacaggaagattattaatcaattatgaattattaaaaaataatttaccacctattgttatacctattgataaaagagatgcttattttcaatatattgctaattatgacgaagaatcttttgtttatatgattaaagatttaatgcaatatgaattagaaagaattcaagaatttaagaatatgtaatatatatattgttattatcaaagtggaggtgttcgacataaggtccgtttgctccaccaaatttaatacatggttttgatgttattgaaaaaattgattttgtcgaagttttttcaattattttaccgaactttaaaatacctatttatcgtggatgtcatcatattttggaggatgttattggctataaatgggcttttttatatatactttgcgcggtttggctgtcatatatataaagcaaatttgtgtaaagacaatatatttattaattgatatgatgaaattgttcaaagaaagataaatggaaattgatggggataggataattatgaaaaaatataatataagtaaagaatttggattatttgcccatttttcacctccatttaataagttgatatttcccatgtcttctttaatattgggtataaccccaaagttgttaaaaagtagtggagatgtaaaaatcatacgaaaaaaataaaaacggatgataaaaaaatattgatttatatattttcaatcctataaatataaaaactgataaaatgattttatatatttatggcggaggatttgtttttaaaggatatgctagtcattatcatctttgttcaatatttgccgataagtgtcattgcaaagtcatatatatagattattgccttgcacctaaatataaatatccaattcccttgaatgattgttttagtgcatataaatggattatagaaaatgctgattatttaaaaattgttataaataaaattattgttgcaggagatttggcaggtggatgtttagcagtcgacgttactttaaaaacgatccaagaaaatataataaaaccatattatcaaatgcttatttatcctgtattagataaaagaatgatgacattatctatgaataaatatactgatacgccgatgtggaatgcaaaattaaataaaaaaatggagatattatttaggtaatagggaatatatttctcctaatgaaaggcaaggcttaagtgaaattccaccaacatatattgaagtagcagaatttgattgtttgcatgatgagggaatagaatttgctaataaattattaaatagtggagttgatgtatcattatctgaaactaaaaaacaatgcatggatatgatatacaaaaatgtgatataacgaatacagcgataaggaaaagaatagaaatattaaattcaatggaataaaattaataataaattagaatttatcgagttgatgaaggaggtaaaataatggaaaatatgtcatttgaagaattattaaagataaattgtttttcagaagataaagaaaaacagcgaaaagcatcagaattattggaatatcgttatggatgtgaaattcattgccaagatatggataaaagtgttctttttgctcatcatgcaagaggttgtacaatcgtagctgcaaaaatttgcaagaatgtagcaatctatcaaaatgttacaattggctcaaatatgaaatataacaaactaaataatgaatgggaaaatgtggggagtccaattattgatgagaacgttataattgcagatggagcgaaagtattaggacctattgtcataggaaaaaatactgtaattggggcaggagcaattattacaaaagatattccagaaaatagtattgcttatggagttaatcaatataagcctaaaaatccagattatgatttggtatttaataaaaatatgatttctggcgaagaaattgtgaaaattaatgaacaaagagtagctgaatttgacaaaatgaaagaaaaataacaaattccagtttataggaatatgttatttcttgttagataaaatagtttgtttacgtgttattaaaacttgaaataataatgaaaatgtaatcatgtattttatttagggtaatgctaattaggtataattatgcacgtttatgcaaaaactatgcatcaaacttagtatattcacgaaaaaatcaattattttcgttttaaataaatataaaagacttagaattaatgaaatgattaagttctaagtctttttgtttgaatttgagcaaattattatttaataagtttatgctaaaagtgccaacatcttaatgatagctatttacaatcagcagatgaaaatcaatattctttgctaccttgttattgattttttgatattgataaatatatttgttgcagtagtagaaatcaatgaataaatataaaaagttttttaatatctataatattatcgtagaataatcaaaaaattcaaagttttaggataattatatttgatttgttaaaaatatagttgagtataattttatttttttgaaataaaagaaaggatgaatttttttgattctagtaattgatgatgattatcaatttgcaactattttgaaacataaattattaagatattatgatagtaataagataaaaatattaacggattttgattatgaatttttagttaataacgacatagaaattctttttttagctatggaattaaatggtaaagatggtgttgctcttattaatgaatatcgtgatcaggaagatgataaattagatgttgtttttatttcgccatatgatggatttgactactttgtttatattaaatatcctgtatactatatcacaaaaatggatttagaggatgatctagcaaaatgtataaaagaacttaagcaaaaaaatgaagggaaaagatcagaaattataattgataataaattaggcaagataactgatgttatgtatataaaattaagattgaatcatgcttattactatacaaaagataataaaaaatataagaaaaaaaacaatttttctttaattaatacggaattaaaaaagtataattttgttagatgtcatttattttatatgataaatgttaagtatattaaaggcattgatgataaacaggtgtttttagaaaataatatcatcattcctgttagtaaagcatatcgtgatgaggtatttaaagaatatagaaaatatagatttgagtaaaatatatgttatttttaataatgaaaagactattgattattgttaaaatataaataaattaaggaaggaggatataaatgatggatgatcgtatttatattgcaattgatttaaaatcattttatgcatcagttgaatgtgttgagcgccacttaaatcctttaacaacaaatcttgttgtcgctgatgctagtcgaacagaaaaaacgatttgtcttgctgtttctccttcattaaaagcttatggcatttcaggacgtgctagactttttgaagtcattcaaaaagttaaagaagttaattatcaaagacaaagaaaagttagaagaaaactaactgctaaatcatttgatgatgaaaaattaaaacaagatcctaatcttttagtatcctttatagcagcagtaccaagaatggcatattacattgaatatagtaccaaaatttatgatgtttatttaaaatatattgctccagaagatattcatgtttattctattgacgaagtttttatcgatgcaacaagttatttaaaaacatataaaatgacagcccatgaattagcaaaaacaattattaaagatgttttgataacaacaggtattacagctactgctggtataggaactaatatgtatttatgtaaagtggctatggatattgtagctaaacatacgatgcctgataaagatggagtaagaattgctgaacttgatgagatgtcttatcgaaaattattatggaatcatcgaccaattactgatttttggcgagttggtaaaggctatgcccaaaggttggaaaaggaacaattatatactatgggcgatattgcaagatgttcattaggtgatgaaaaagattattataatgaagaattattgtataaaatgtttggtgtcaatgctgaattactaattgatcatgcctggggttatgaatcatgtactattaaagatgttaaagcttataaaccgcaagataaaagtatcggctctggtcaggtcttacatgaaccgtacacttatgatagagcaaggctggtcgttaaagaaatgattgatttgctagctttagatttagtagataaaaatctagttacggatcaaattgttttaactgttggctatgatattaaaaatcttacaaaagaatcatatcgtggtgaaattgggaatgatcgctatggtagaaaattacctaaacatgggcatggaactgctaatttaaagtttccaacttcatcgacgaagttaataacagaagctgttttaaagttatatgatcgtattattgatagtagtttacttataagaagaataaatatttcagcaaatcatcttgttgatagtaaatctgttgaaaataaagaatttcatgaacagttagatattttttcatattctgatattaataaagaaaaaatagaaaaagaaaaagtaaaactcgaggaagaacagcaattgcaaaaagctattataaaaattaaaaagagatttgggaaaaatagtgttttaaaagggatggatcttgaagaagatgcaacgactatagatagaaataagcaaatagggggacataaagcatgataaaaaaagattatagtgatattatcgatcttcctcatcatgtatcaaaaattcatccaaaaatgacaatgaatgagcgagctgctcaattttcaccatttgcagctttaacagggcatagcgaagctgtgaaagaaactgctagacttgttgatcagaaattagatttagatgaaagccaaatagttattattaataatcagctaaactatatcaaagaatatattgaagaacatccagaaataactattacttattttcaacaggatcataaaaaaaccggtggtgcttatataaccggttgtaatagagttataaaaattaacgattataaacgattgcttatcttagaaaatgatataaagattttatttgaagatatttatagtattgatgatattagaactaaggattaagaagtatattttttattaattttaatttaatcgatttaagatgaatgctcaaattttgtatagcaaggatacttatatttagtatccttaaatttttgcaatcaataatacatgattttgataaaaatagtttagttttgatttattatgaaatggaattattgatattacttaaataaaagttgatttatgctaaatgtgtttatttcgatacatttttttcttattgattgacggtagtaataatatcctttacaataaagttaccaattaagaaggagacaatttatgaaaagagaaaaattatcttcacgtttaggatttattttattatccgcgggttgtgcaattggtttaggaaatatttggcgatttccatatatggtaggtaaatatggtggaggagcatttgtattagtttatttgttctttttaattattttaggcctgccaattattgttatggaatattcagttggtcggggatctcagaaaagtgttgcacaaagctttcacgtgttagagaaaaagggacaaaaatggcatttattttcatatgttgccatggcaggaaattatttattagtaatgttttatacgactattgcagggtggatgctagcttattttgtaaaaatgttaaaaggagattttattggtttgtcaccaaatgaagtaggtaatgtttttacaactttacaagcagatccagctgctagtgttttttggatgatattgatcgttattattggctgtgggatctgtgctgttggattacagcgcggtgttgaaaaagtaactaaggtaatgatgggattattgcttggtgtaatgattttattagttgtaaaatcattaagtttagatgatgctatgaaaggtgtcgagttttatttaatcccggattttaatgttttaaaagaaaatggaatctttaatgctatttatggagctatgggtcaagcattttttactttgagtatcggtatgggtggtatggctatttttggtagttatatcgataagaaacattcattgactggtgaaggcttaagagtgttgatattagatacttttgtagcagttatggcaggattgatcatatttccagcatgtatgtcatttaacgttgatgctggtagtggacctggtttagtatttgttacattaccaaatatttttaatgccatggatggtggacaaatttggggaacattattttttgtttttatgaattttgcggcattatcaacgatcattgctgtttttgaaaatattgtttcttttacgatcgatctatttcaatggtcaagaaaaaagagtgttattttaaattttattattattgttattggtagtattccatgtgccattggatttagtattttatctggatttcagcctttaggagcaggaagtgcggtgttggatttattagactttttagtttctaatgtaattatgccactaggatcattagtatttttattcttttgtacacgaaaatcaggttggggatggaagaattttataactgaagctaatgcaggtgaaggtttgagttttcctgaaagagctagattttatgttagttggattttaccattgatcgtgatttttatatttttatttggattatgggaaaaattatttatgtaattaaacaatttatcttagatgatagtaatttgaaatgtaatattttgaattactatttttttatagaaaatttagaagtaattgaaaaaattatggagtaaataataataagttaataattttaaagggaggaaaaagtcttgaaattaatttatttttatttatttgttgtagggagttgtgtagctagttttgcaaatgctgtaatttaccgcttgcctaaaaatatttcaattttaaaaggaaggagttattgtgaaaagtgtcatcatactcttcattggtatgatttattgccattgattagttatctttttttgaaaggaaaatgccgttattgcaatgaacgaatatccaaaaatcattttttatttgaatgtttgggaggtttattattgattttgtgttttcaacagttgaaattgacagtagaaatgataattgtgttttttattataatgggattagttgtaattgcagttattgatcagcaaacaatgaatatttatttatctacaattttatttttgtttatattaataattgtttatcagttgatcatgcaaatgaatcctggtgatcttttagcaggaatgttatgtataagcataccgatgattatgattaatttaattattcctgatagttttggctttggggatattcaattagtaactgtttcaggaatgctcttaggctggaaaggtaatatttttgctgtttttattgcatttattatcggaggaatatatgctggatatctattatttagagataaagtgaaaataggcgagcatatcgcttttgggttatttcttgtagtgggaataataattgtactgttgtataaaactgagttggcaaattggtacttatttagtttttagaaaagataaatatatatttatgtttataaatttaaataagtatgagtttatgtgtattattttgctataagttgtattattttactatttttttacgatataatataaatataaattataaatttgctattattaatttaaatatttgatttctataaataaataaagataatattatcatatttttgatagtaattacattattttaagcagtgtttatgatacacatgatcgtaaaaataataaacataatatttcaatagcatatctttaggtttttcgtaataaaattatatatttgatgatattttcatatctatttgtggtagttactaattatattattataataaactaaaatattttagtacgttttaaaaggaaaatatacgtggatttacaatgcctaaacaaaaaatagagaggaggtcttaattattattttttggcatttagataaataatatgatgcgaaaggagaagattatgaaaaaaataagaattaaattaaaatgtataggattatattttttgagttttttacttgctatcagctgctgttttaaaatgggcacgagtgtctttgctgaagagttagaaaatgtagcaaaatatggtatagcttatgctgactcagaaaataatccagcaagttttttaaatgacgggaatactagtaatctttggattgctgctagttcatcatgtccagctagtgctggaattaaattagatgggatttatgatgttaacagtgttaaaatttattttgaaaagcaaagagatgttaaccaaaaaattcgttttacgctttcttatttagataatgttacaaaagaatatatagaattttatgaaggattaaatctaaatgaagaaacaaatacctatgatacagaatttgtttttgatataccagtaaaaacagatgatatcaaagtaacgattacagaaagacttgaagggacaactatttggcctgctgtttctgaaattgaaatatatgcagtagataatgtaggaaatcatgaaaatgaaatttccaatgttgcattaaataagccggttgaagtaagtgctggcactaatggagcagttataacagatggtgctacaggtgccttttgggacggtggcgcagcaccagcagaatttattattgatttaggaacaggtcattttatttctaggtttaaagctttaacatattatggcgataatagatattatcattacgaaatttatggtagtttggacggattaaattatgaattattagctaaaaaggataataacaacatagctagtagtagtggtgaaatttatgagttggatgaaatagcaaatattcgttatattcaggttataatgacatataattccgcaaatccatctgtacatatgaaagaatttgaagcttggggttatcctgatccagattataaagaaccagaaccagctacttctgatactaagtatccggataatattgcttatggaaagccagcaagatgtcatgtttcaaatgaaggaatagaaagagtgacagatggttctgatgcgacttattatgttggagaattttatccagcagcaattgatgttgatttgatggaggagtatgatttaaataaattaattcttaattttcctgtaaaggaaggtagatattattactatacgatatacggaagtaatgattattctgtttttgatgaactttatcaaaaaagagataaaacatcgacaacattagatggtgatattattgatttatcagctatagaaggcttaaaaaataaatcatatcgctttattcgtttgtatcttgagtattgtaatgatggaggtagtgctcgagttagtgagattagagcctttggaacgccaactggagaaaataccggcgagttacgaacaggatcaattgaagatattttagaaattaaaccatttaatgaaacagagtatgctgcattgattacagaagatgaaacgattgaaaatgtatatggtatcatagatcgtactgtgggtagtcaatatcgggactggtttagttttgaattggtagataatttagaaaatgaagatgatttttatgaactaacaatgaaaaacggtaaagttcatataagtggtaatgaaggtgtaatgctttcagcagggttaaattattactataaaaattattgtaatgtaaacatttctgagcaaacgatccaaaataaaatgcctgaatcaattgtagcggttatgccaacacgaagaacaacaccttataaagttcgttatgcatttaattattgtacaatggattatacatttgcattttttggagcagaagatttccaaaaagaatatgattggttagcgctaaatggcgttaatgtagtacttgatctagctggtcaagaagctgtatggatcaactttttaatgaattataactattcttttgatgaagcaaaagactggttagcaggaccttcttattatgcttggcaatttatggataatcttgagatatttggtggtccggtatctgatcgctgggtaaagggacggttggagatggctcgagaaaatcagcgctggaaacgttctttgggaatcgatacagttttgcagggatatgcaggaatgatacctacagattttgcaaatcatcagccggatgttgaaattttaaaacaaggtggctggtgtggcttaaatcgtcctgacatgattcgtaccgatggtgcactttatgatgaatatgctgcaactttctacaaagcacaagaatgggcctttggtgaaactagtaattattatgctgcagatccattccatgaaggtggcattcgaccaagtgatttatctgatacaacgattgcttcagaagtacttgactcattgttggaatatgatgaagatgcagtatggatggtacaagcctggtggagtaatccaacaaatgatttattaaatggaatgggtgaatatcgtcaagaccatgtgatgattcttgatttgacaggattagaagcacctaaatgggataaaacaagttatggcagtaccgagttagatgctccagaatttaatggtacagactgggtatggtgtatgttagaaaattatggcggtaatccatctatggatggacagctagctaaaatggccaatgatattccaaatgcttataaacaggcagagcatatgaagggaattggtatcattgctgaagctcaatatgataatccagttatttatgatttgatttgggatatggcttgggaaagtgaaccggttgatatagatgattggttagatggttatgtagttagacgatacggtagtgaaagtacaagtgctagaaaagcttgggatctgttggaagaatcggtatatcgaagaagtgggaatactacatatacattggcacgattaccagaaaatgtaggtacacaatctgttggttataatactgaaaagcttgagcgagctttaatgcttttattagaagattttgatattttaagttcaagtgaagcatatttgtatgatttgacagaaattatgaggcaatgtgtaaataattatgcagttactcaatacaataatgttattgccgcatataatgaaaaaaacttagaaaaattccgtattgaaaaagaaaagtttttaaatgcttttgatatatgtgatgcagtagaaggtacccaggtagatcaattagttggagaatggatcggaaaagcagaagattgggctgaaaatgatgatgatttttctaaaaatgttttaccaatgaatgctaaggcattaataactacttgggctggtgcagctagtgcaagtgcactaccagattatgcatatcgtaattatcaaggaatgatgatagatgtgtataaggcaagatggcaaacgtttttagataaagaagaacaatatttgattgataacacacctgtggatcgattaaatcaatcacaatatttccatttttattgggaatgggtgatgaatacacctgaatatacgagagaagcaaatgattctccgcaacaaatctatgaagtggctcaaagagtattaagtgattgttcagtgattattgaacgtcctgagaatgtaggaaatattgcacttgataagaaaatatgggcaaatgaggaaagaaattcgccaggttcaagtggtggatatgcgtctcatgcaaatgatggaaatcctgatacatattgggatggtggcgaatgggaaacaaatgacccatggatcattattgatttggaaaaaacatatataattgaaaaaataaatattttaccatatgttgcaaatcgatattatttatatgatctttatattagtaacgatggcgaaaattggattcaaattgagcataaaacagatcaaactattggaacaaatgaaggtgatacttacacatatgatgatggcttacaagcacgttatttaaaattaagtggtaaatataattcagcaaatgaatcgttccatattaaggaaattagggtttatggtaatgagatagaaataagcaaaacagccttacaaatagctgtagatacagcaaatatattaaaagctcaaggggcattggataatgttgtgccagctgtagcagctgaatttgaaactgcgttaactgaagcagcagatgttttagtagacactggtgctgaccaaactacagttgacagtgctttctatcgtttagctaatgcaattcatatgttggaatttgtaaaaggtgataagagtactttagaagccttgatcaatgaagccgaaaaatatgaagaaggaaattatacgactgattcatggacagcatttaaagaagcaatagaagtcgctagagatgtcatgaatgatgaaaatgctttagaaagtgatgttaatgaagcgttaaataacttaacagaagcaattggaaatttagtcttaagagctgataaaacaagattacaagaagcatatgacaaagtagatggcttagataagagtctatatactgaaaacagtgtagcgggattagttgagccaatggtagctgccaaagtagtattagatgatccagatgcaacacaagctgaggtagacgccgcatatgaagcattgatcagagcatacttagacttaagattaattccaaataaggatctattacaagggttgatcaataaagctgagacattaaatgccacaaattacagtgctaagacatggtcagtgatgacaaaagccttagatgaagctaaagcagtattagatgatccaaaagcaactcaggcagaagtagataatgctaaagaagtattaacgaaagcaatggctggattagaaatgattgaagcaagtaatccagtaaaagccggcgatacaacagcaagtgtagctactggagataatggtttaattggaatctttgctagtttatcagttttaagttttgcgggattaagtttattaagaaaaaaagataagtaatgataaaaagggaattttgatgttttgcatcaataattcccttatttaatattttgtcataatattacaacaagataaaaaagaatcaaattaatgattcttttaatgaaacatatcttttttcataaatataattgttgcaataatacaagcaataacggcgattaaagttggaaaccaccagtgagcaataggcaaaccagtaacattcattccataaaaactaaaaatgatgtttggaattgacattacgatcgtaataaccgttaatactttcataacaatatttaaattgttggaaataacggaagcaaacgcatccatagttcctgaaagaatattagagtagatgttacacatctctattgcctgcttaatttcgattaacacatcttctaataaatcttgatcttcatcgtataatttaatgattttaccacgcataattttatttaaagtgatttcatcagtttttaaagaagtagaaaaataaactagtgatttctctaatcctaacatttgaatcaattctttattttgcatagacttatgcaaactttgttctgtacgtgatgaaattcgatcgatttgacgtaaatatatcaaataacgctgagaaattctaagtaacaatagtaataaaaatcttgtttttaaatgagtattgatacccttaacttttccttgcgccatatcatcaatatttagattttcatataaagatattgttacaatatgacccttcataataataatacctaaaggtaatgtggtatattgaagcatatttttatcataaccttcagcattttcgtcagcactaggataatcgatgatgactaatctttggttgtaatcttcatcgtaatcaatatgcgaactttcttcagggtccaatgatgatttaacaaattctggtaaaataccaattttctctgttaaaaaatttttttcttcttcactaggagcaacaacattgatccaacatcctaactcgggagcatcgattttttttgttactgttccatatgttttgtaatattctaacatcttagcctccatcccaggagactaattaattatgtctcctgtatttttttatttaattgtttgatatacacctgctcgggctcaggggacataataacaccttctttcaacttccatattataccatagattaaaatagttttctaaaaaataattaaatttttggtaaatatttttgttatttattttaattgaaaaaaattaatgcaaattaagaaatattacacagaaactacacgactttatgataaaataaaaatatctaataatattttgataataataaaggagttgctctatgaatgataaattagaacttttaattaaagaggttaaaaaggcagttttaggaaaagacgaagttattaaaagaatggtagtagctattctagctcaaggacatattttattggaagatatccctggggtcggtaaaacaaatttagcggtagcttttaccaaagctttatccttaaactatcagcgggtgcagttgacctcagatgtattgccaagtgatctactaggctattcaacttttgattttgataaaaaagagatgagttttaaaaaaggaccactttttacaaatatatttttagctgatgaaattaatcgtacatctagtaaaacacaatcagctttattgcaggttatggaagaggggatgatcagtgttgatggtaatacatatcctgttaataaaccttttgttgttattgcgacacaaaatccttttggaagtgctgggacgcaaatgctgccggactcacaactggatcgttttatgatgcgtttatcaataggttatcctgacgaagtaagcgagattgaaattttaaaccgtaagaaaaatggtaatccccttgataaaattaatgctgttttaacaccagaagaattaattttaatgcaagaagaaataaaagatgtttatgttgaggaaagtttggttcgatacatcgttcaaatagtccaacagacgcgtgaacatgaaaaaattgagcagggagcttcaccacgagcttcgattgctttattaaaagcagctcaggcgaccgcttatttgtatggtcgtgattatgttattgttgaagacattaatgagaatttatatgaagtacttaatcaccgaatcttttttattcctggcatgaaaaaaaatcgtaaggcttttcagattataatggaagaaatcatgatacggatttcgccagttacttataagtgattatgtttcgatatcgtttaatttatttattgttgattggatttggtgtatttttctatttcacttttataggttatttttcttattactttttattagttgttttactcttaccgattatttccgtaatttatttattattagcttggaaatttataaaattagaatttaaagtgaataagggaatcgttagacaaaatgaacaagttaaaatatttgtaaagcgtgataatcttggtttaggggcgatcaagtttaagattgataataaaaaatattttttaagaggtagtaatgaggatcttgatttgatatttaagcattgtggtggtagaaatttgataatcaaggaatattatcagtatgatagtttaaatttattttgtttaaaaaaacgctgtaattatcaaataccgataacgatctatcctaaagagacagattttgattttgaaatatatcaaagatttttaccaaaatatgaacaagaagcatatacggttaatcaaaaaggtaatgatcctacagaaatatatgatattcataaatatcaagaaggggatttgttgaaaaatattcattggaagctaagtgctaaatatgatgccctcttagttaaagaaaatgctttggcggtcagtgaaatcgttaatatatattgtatatttgataatgatgatagtcataatgatttagtttttagttatcttgagggtttttgtaaatatatgttgagtaaaaaacttgattttattctttcaaataaagagattacaagttatcaggagtatgaagaaaaatttgaatatttgttatggcataaagattatgatttggctatgatgaaacgtaattatgaatttgttattgattatcatgggattaaaagaatagagggtgatcgacgatgaaactattgatttatatcttgggaattattggttcaactggatcattaatttattcgtttaattttaatactagtccccacttgatttttgttttttgtattatggtaggtttgtttatttattttggttatatgaatataaaaaataaaaataaattcatagtgggtggattgatttttgaaggtgggttattgattcttcctaaaacaataacttgtttttcatatttagtttctgttgtcgtgcataagtatcgggaagtatcggtttatcagctaagttatcaaagcatggtaaattattttgatgacccttttgtttgtatttgtgcgtttttgttattgtttattcctatgtatattttagctttaatagcgattgataaaaacaaacactttttagcgatattcgctctattgccaggagtgtttattgaattattatttacaattactccaccatggtattatattggcagttttttactatattttttagttttattcattaatggattacaaaaaggaaataagataaaaatagctgtaattggactttgtttattttcgatgacttttacatatttagttttttcaccgcatacatatcaggtttcaccaataaatttatttaataatgctaaaacaccactaactacagcagggggaagttttaaaaaagaatatgatataaaagaacaaggaaatcgatattatcgtaattcaatagattttgttgttgagggagctagtgagttaacgaattttaaaatccgcggaattggttacgatcagtacgataatggtaaatggagcattgttgatgatgagcgaacttatattgactgggtttatcggaatttggatataattaataaagtaactaaagtatcgattcaaaatattagaatcgaacaattaagtggttatacatatcgtaattatgcaccatattatttttcaaacgataatttaacttattataataattattttatgggtgaaaatccagaaacatatgaaatgatcgtcccaaataatgattttaatgaattattatcaagtgttgatgctagtgtaaaaaaagaaaaacttcaagagatagctgctagaaatggaactctggaagatataaaaaatatgcagacttatcgttatcaaaataaagatattttaacagctgtttctgatgaggatgctaagattattgaccagtttctattagaaaataatattgtttataatggtgatgtctataatttgattgaccaatgtaaaaatgctttagcaaatcaaactacatatactcttaaaccaggtgatttgcctagtggtgtaaattatttagattactttttaaatgtacacaaacaaggatattgcgttcattatgcttcagcattagctttaatgttaagaagaaatgggatagctgcgcgatttgttttaggatatcaagctgatggcagcaaagatgctgatggtaagttgattattagagatcgtaacgaacatgcctgggttgaaatttttgatgattatttaggctggattcctattgaagcaattggcgcaggagtaataagtcaagacgatgaaacatctcctattactgataataatcaaaataataatcagactacaccaattttacctaatcaaactcaagaggaaattagtacagaaactgaatcaacaatagtgataccgttttatgtatattttttaggattatttatagctggattagttgtaattgttttgcaggcagtaattagaaaaaaaagaaggtttaaagatgcaaaaaataataatcaattagtatgtttttattgtcattatttaagtaatctaaatggtgatctttctggaattaagaaaattggcgataaagctcgtttttcacctcatgaaattacagatgaggaattagaatttgttgcaaattattattttaagcagcttaaaataatatataaaaaagcaaatatttttaagaaagtatatattaaatttattttagcttatttatagtttagtgactgcaaaaagaatgtgattgacaaattatttagggtatgatacatttaatacatatataaactattgattgggagataaaacattgagcgcgcttgtagagagtctaggacggtggaagctagatagagatgcggctttggtaaatggacccatgaaggcaaaggggaaaaagtaattttgagtatcttttgacggttagcttacgttatcaagctaaaatgtgatagcatttattttaaccataaggtggcaaagcagattaattataacatctgtccttttaggacagatgttttttgtttaaagggggacaagtatgaagctagataaacgatggtgtaggtgcaattaagatgaaataaaaaattaaagaaaaggggacaagaaaaatgaaagtaagtaaattatttaaattaatggctgtatcagctttaacattaggggcattaacaggatgcggtaataaaaacaatgaagagataaaagaagtagcgattattcaatatgtagaacatacatcattggatacgatcaaaaaagcttttgataaacaaatggaggaattaggatataaacaaggagaaaatattaattatacatttaagaatgcgcaaggtgatgccaatacagcaccatcgatcattcaaggttttcaatcagaaaagaaagattgtgtagtagcaatagcaacaccagttgcaatgtcagcagcagttatggctaaagatactccagttgtctttgcagcagtgacagatccgatttctgcgggactaacttcttcgcttgaaaaacctgataagaatattaccggaacaagtgatgagattcaagttgaacagattttagaaaaggctttagaagttgatcctgatttgaagacattaggagtaatttataataagggtgaagttaattcagttactaatattgaaaaagctaaagctttttgtgagaaaaataatatttctatagtggaagggacaattacagcagttaatgaagtgcaaagtgcaattgatgttctagcaagtaaaagtgatgctatttttgcaccaaatgataatatggtagctagtgctatggatatggtatcaactgcttgtactaaagctaaagtacctttatatgttggtgctgattcaatggttcaagacggtggttttttaagtgtaggaatcaattatgatgatttaggtaaagaaactgctaatatggttgataagatcttaaagggtgagaaagtagaaaatataccggttaaagtatttaaagaagatttaagtatttatgtaaataaaaaagtattagatgagttaggtatcactttacctgatagtattaaaaatgataaagcatatgtagaaatgtagaggaaattatatgagtcagacggttattttaggggcgttagaattaggagggatttttgctgttctttccctggggttgtatattagttataaagtattgaatatacctgatttgacagttgatggaagttttactttaggaactgcagtaagtgcgatgttcacaattaatgcgatgccatatcttggaatcctagcttcatttttaattggtgctgttgcaggaatggtaacgggattattgatcacaaagttaaaaataatgcctttattatcagggattttaacaatgacaggattatattcgatcaatcttgcaatcatgaatgacacaccaacgatctctttatttgataaaacaactatttttagtggtttaaatgaaattacagcatatgggaaactcatcgttatttatattattgtggttttgatagtaataatattagatttatttttaagaacgcagttaggcttatctttacgtgcttgtggtgataatgaagatatggttagagcaagttcgatcgatactgataaaatgaaagtattgggattagctatcgcaaatggttttgtagctatgagtggtgcgatttttgctcagcatcaaagttttgccgatgtaaatagtgggattggaatgatggttattggtcttgctagtattattgtaggaatgacgtttattaaaaaggaaaagattattttccaattagttgcagttgtttttggggctattttctatcgtgctgttttaacggtcgctttacagttagggttaccatcaggatatttaaaattattgtcagcattgcttgttatcattgctattgcttcaacaaatggagcttttaaaagtaagaagaggagaagaaaatcatgttagaacttaaaaacctatctgttatttttaatgaaggcactgttaatgaaaaagtagctcttgctaatgttgatctaacattgaattctggtgattttgtaactattattggcagcaatggggctggaaaatcgacattatttcaagcaatctcaggagctgtagaaactaaaagtggaacaattttattaaatgatcaagatataacttttgaacctgaatataaacgttctcgagtaatcggaagattgtttcaagatccattaaaaggaactgcaccaaatatgacgattgaagaaaatttacatttatctaatcagcgtggtaaacattttagtctaagcttaatgtcgcatcgtcaccgtgagaagtttaaagaagcgttaaaagagttggatctaggtttagaaaaacgtctggatactaaagtaggtttattgtcagggggacaaagacaggcacttactttattaatggcaacattagtaactcctaatttgcttttattagatgaacatactgccgcattggatcctaaaacagcacataaagttttagaattatcaaaaaagatagtagatgaacataagattactactttaatgattactcataatatggaggatgctttaaagtatggtaataaaacaatgattatgaaagatggacgaattattgctttgattgaaggaaaagaaagagaggaaatgacagtagagggcttgattcatctttattcaacttcttctaatgagtatactgatcgagtattattaaaataatttaggaaatatttttggttttttaaaagatgttattatctattgataatttatataaaaaataagtgttatgaaaaagtgctttaatgaaaactttttaaagtttctaaggcactttcatttttgattttgacctttgcagtttatcacaaactgttttcatacattataaaaatactttttaatcacaaatatgagctaaaattatttgagttaatcacatagtgattttcttattgatgaatagttacgaaaagttagaaaaattattaatttttctatttttaaatgaataaaaatatggtaatatatcattgtcgtagatttccctgttccaaacacttaaaatttaagatctacgactttttatatgttgaatttataatatgagtttgtttaaacaatattttatttttagtattattagatgataaagttaaaggacttgaaaaacggaaaattatagatgaattgatcttatataattttaatgatggaagatacagaaaataaaattataatagcgaactgttaaaagagatagaaagaattgtcatttgatttaggaaatattcctagattttttttagaaaaaatatttttaattcatataatttaatcatgataaagttatgctataatggttttataacagataaaggggaagtttttaatgtatataattggaaagttgtatcaattaagaaataactcagcttatgatgaaatagactatattatagcgaattatttaataaaaaacttaaacaaaattgatcaaatatcattaaagaagattatcaaagatattgctgtctccaaatcaacgattacacgattttgccaagatgtaggttttgatggctatttatcattgagaaatgaattaagtattgaagcaaacgagatttttcaaaaattgtattataataagactataaatttaaaaaattatcaagaaatcaaagataagtattttcaggaatgttttcgctttataactaataaacaacttgctgatattgtcaaaatgataacatcaagtaagtctatcgttttatatggagatatcttttattgttcattatttttatctttatcccattatgtaaataatttgtatattcctaatttatggtcattacaaaaacaagaaaaatgtcttgataatttaacagctgatgatttactgattattgtatcagtgcaatatagttactttagttttaaagaaatggcgatgttaaagccaacggttcccaaaaatctatttacccatcaggctaagcgattatttatcggtagtatgggagcttctagttatgataaaacggtctgcctatctttagtgcaaacaagatataattttttatatcaagaaattattttagagataattaataaaataataattcaaataaatcgaggtgattagatgaattctttaattagtatgtggctattgatcataaataatgctcttattgaagatgcaacatataatattgcacgatattttattattaactataaaaagttagataaaatttctatttctaaagtagcaagtgactgtttaacttctccggcgactattaataagttttgtcgtcagattggttttcaatcatatcaagatttaaaaagccaagttaaatatttttatcaaattagaatgaagcaaatggaacatcgttttgaaattatggatgaacaaaaattattagattatttaaatatagatgctaaagaagaatttcaagaacagatctatcaggcagcaaaacttatttatgaagctaaacaagttagacttgtaggagcaacatatcctttagctttagcacaaaattttcaagaagatttaattatgatggataaattagtttttttccatcaatgtcttttatttcgtgatgatgtatcatttatagatgatgaattagttattattgtttcgattacggggcgtatttttacgcataatcaaaatttacttaataaaatttttagtagtaaatgtaaagctatcttaatttcacaaaatttatgttgtgatattaatgatttatctttatatcttcagttaccaggtttgaatgatagtgaattggttaattttagtttattagctacatattatatgattaaaaacagttattatcataatttttatcatgaaaatagttgtttttaatcgtttagattataaaaaaattaagaatatttaatgatttagtgtgaaaagtccaagaataggttattcttggattatttttatgacaattttttaatgttatcgtattatttattaaatttcagtgaaattaattgttaaaatacaaatattagattgcaaaaagcgacatattcccttataattcaattaaagtttaagcaaaaagtccaagaataacctattcttggattatattactaaactttatgacaatatttttaatgaagtaatcactgactagcgcatgttacggaattaaaatgattataagaccctgagtgtaactaaaaatattacatagttgcactggggttttattgtcttttggaggaaattatgcaaaacttttatgttttagaagtaaatagagaaagagaggaagagatattagatatttttaaatccgatatttttaatgaatcgatatgtaggtgttttattttgaaaagaaaacaggctcgaaaatttggtttggaatggaagatatgtgtagttgatattcttaagggaataattttttttgaaataaaagatgttgatttatttaaagataggttaaaaaaatgtaaaagattttttgagttgaataatcatcgatgtgtgaagttaaaaagattgaatgaaaatgatatatcttttattaagaagtttgaaaatgattcaatgataatagctcattcaattggtgatatttacaaagacgatattattgtaaaagaggggccactaaaaggattagagaatatgattagaaaagttgatcgtcataaacgattagcttttttaaaatataaattttcttttagcgactatgatatatgtcttggtttagaaataaaaaataagataaggggagattaagatagaaaaattattaattataggagcaggtggtcatggcagatgctgtttagatatcgctagagaaacttatgatcacatcgccttccttgatgataatcttaacaataaaatgatcaatgactctaaagtcattggttctgttgatgatatgaaactgttttatcctgaatataaagatatctttattgctgttggcaataacaaacttagaaaacagttgattgataaggcagagatgatcggatatgatttagtttcactgctttcaaaaaacagtatcatctctaattatgctttcattggtaaaggaacggttgtttttcctaatgcggtcattgaagcaaatgcgactgttggtaatagctgtgtcattacagctaatactactgtcaatcatgatgccattattgaagatcatgtccttatttattccaatactgtgatcagacctaatacgctgattggttcttattcacgtatcggaagtaactgtactgttacttttggtactaagataaaggcaaacagtaatatcgatgatgggatgacagtgggcaatgatgatgaatactgttttgaaatgggggtatagggatgtatcgaaaaggaatcaaaagagtcattgattttattttggctttagggggacttattatcttaagtcctgtttttattattctgtgtctctggataaaacttgacagtaaaggaccggtattgtttaaacagaaaaggatagggatcaataagacatatttcaatattttgaagtttagaacgatgtacatagatacacctaaagatatgccgacacatatgttaaaggatccagatcagtttataacgaaagcaggaaagtttttaagaaagacatcactggatgaactgccacagattatcaatatcctaaaaggagagatgtcagtgatcggaccaagaccagcgttatggaatcaggatgatctgatagaagaaagagataaatatcatgccaatgaagtaagaccgggactaacaggctgggcgcagataaacggtagagatgaactggaaataccggtaaaagcgagattagatggagaatacgtagaacgtatctcttttttatttgatctaaaatgtttctttggaacgatagcatcagtattaaaaagtgatggagtagtagaagggggaacaggatcgatgaagggagaggacagatgatgaaaaagattctaataactggagccaacagttatatcggaacatcatttgaaagatatataaaggaaaattatccggaagattttcaaacagatactctggatatgcttgattctgaatggaaagaatatgatttttcaggatatgattccatctttcatgtggcggggatagcccatgcagatgtaggaaatgtcagtgaagaaagaaaacagctgtattataaagtgaattgtgatctggcctatgaaacagcatcaaaggcaaaagaatcaggagtaggacagttcatttatatgtcctcaatcattgtctatggcgaaagtgcaccgtatggaaaaacaaagatgataactgaagatacgaaaccagaacctgctaatttttatggggacagtaaattacaggcggaaataaaattaacacctttacaaagtgaagatttcaatatcgtgataatcagaccgccaatgatatatggaccaggaagtaaggggaactatccggtactgtcaaaactggctcataagttaccgcttttcccgaatataaagaatgaaagaagcatgctttatatagagaatctgtgcgagtttatcggactgcttattagaaataatgaagcaggattatattttccccaaaatagtgaatatgcaggcacgacagagatagtaaaagtgatcaacccaaaaataaagataaacagattactgaatatcggggtaatgatatgttcaaagatacctgggaaaataagcggactgtgcaataaggcttttggaagcatggtatatgataaagcgatgagtgaatataaaagtaggtatgatcgctacagtttaactgaatcgattgaaaaaacagaggggatagggagatgaaaaagaggatattagtgataactcagtatttttaccctgaaaattttagaatcaacgatctgtgtctggaactaaaaaaaagaggaaatgaaataacagtactgacaggactaccgaattatcctaagggagagtattttgaaggatacagcgctgaaaaaaactgtgatgaagtatggaatgatataccagtatatcgctgtaaactgagaccaaggaaaactggatcgatcaatctagtaagaaactacatcagttttgtaaaagaggcgaataagaaattaagggaacttgaagataaagaatttgatctgatctatgtttttgaagtatcgccaataacagtagctttgccggcaatcaaatttaaaaagaaaaagcatattccgatcatcatcaatatccaggatctgtggccggaaaatatcatagcagtaacaggtatcagcaatccagtaataatcggagcagtaaacaaaatggtggatcatatctataaacactgcgatcttatcttaacagccagtcccagttttgtacctaagatccaggagagagtagaggacaaagataaagtgaaatactggccgcagtatgcaacagttaaaaaaacagatgaagaagtcaatatatatgataaagactgctttaacatagtatttacagggaatataggagaggcacagggaatagatctagcgatagaagcagctcgagaattaaaagaagagaagatatgctggcattttataggagagggaagaagtaaagaaaaactggagaaactggtagaaggatacggattagaagatactgttaaattttatggatttcatcctgaaaatgagattccaggatatttaaaggatgccgatgcagcactattgatacttaagccaaatcctgtattcgagatgacgattccggcaaaactgcagacttatttagcgtgcggggtgccggtattaggatgtgtcagtggagaaggaaagaggatcatagaggaatcaggagcaggtatcgtgagtggcgaaatatctgtaaaaggattagtgaatgtatgtagggattttttaaatatggaatgcgaacatctggaagattataaaaatagagcgtatcagtatggcaatgaaaattttaataaaaataagcttattatgtatctagaaaaatcaatggataaaatataattttttataagaggagaggtaaaaaatgaaagatttaaataaattagctaatataaataagattttagaaacagataatatgagaatagataaaaatattattaagatcagaggtagaacttttcaaatcagtaatatttccagtatatctgtatatgatgtggataaaatcaaatatccggaatgggcagttgttttattaatagtagggataataatattgttcattagtccaatcattggtataggtttagctataatcggaggtgctgtacttgctttgatttataaagaaaattcagtagataaattaaaactgactttatggatgaataatggagaagcatattcattatcaagtactaatatagaatttttatataaagtagcaggagctattgaatattgcatgaatgaaagtgatggttactgtcagattgattttaaagcaaatgatataaccaattgtaattttgcaattggagaatataattcggtgaactagtatgataaagtttgagacaggagatataaattcatcatgtgttgtagttggtaattctaatatggttaaaggaaatagtatcaactctaacagttcattgaatcatgcagattttatagctattaaagaagaactcttatttataagagcacagttgagagaaggaacccaggcatatagtgcagttaatgaggttattgaagctgtagatatcagtagggatacatttatcaaaaaaataaagaaacatgcagttgtgtttacatcatcacttgttattaatttaatttcaagtggggtgtatgatttaatcaaatgtatcatagaaagtaaggggtaaatcatgagtcaatttaaagataaaacattactgattactggaggaactggttccttcggtaatgcagtattaaacagatttctagaaactgatatcaaagaaatcagagtcttttctagagatgaattaaaacaggataatatgagacatgaatatcaggcgaaatatcctgatgtttttcataagcttaagttttatatcggggatgtcagagatataaattctatcaaaaatgctatgtatggtgttgattatgtctatcatgcagctgctttaaaacaggtaccaagctgtgaattctttcctatcgaagcagttaaaactaatgttctgggaacagaaaatgttttaactgcagcaatagaatacaatgttaaaagagtcgtttgtttaagtaccgataaagcagcctatcctgtaaatgctatgggaacaagcaaggcgatgatggaaaaagtgatcgtagctaaaagcaggacagtagatcctaagaaaacaagtatcatgtgtacaagatatggaaatgtattagcatcaagaggtagtgtagtacctctttttattaaccagataaaagagggaaatgatttgacagtaacagaaccaagtatgacaagattcgtaatgacattagaagaggcagtagacttagtgttatttgcatttgaaaatggagaaagcggcgatatctttgtacagaaagcaccagcgtgtacgatcgaagtactggcaaaagcagtgaaggaattattcaaagcagataatgagatcaaagtaatcgggatcagacatggagagaagatgtatgagacattgctgacagatgaagaatgtgccaatgccatagatatgggcaatttttatcgggtaccatgtgataaaagagatctaaactatgataaatatttctttgaaggaatgagtaagaatacattaacacagtttaattctaataatacaagattgatgacattagaagaagtaaagaataaattattagaagtaaagttagtaagagaagaattagcggattgggagaataagtaataatggctgatttaactactattattttaacttataatgaagaaaagaatattgcaaatgcaattaattcagttcagtctatttcaaagagaattgtggttgttgacagctacagtacagacaaaactgtagatatagcaagatcactaggtgctgaagttatacaacatgaatttattaatcaggcaaaacagtttatttatgctttaaataatctagatatcaaaacagtatggatcatgcgtttagatgcagatgaaattatttcaagcaatgcggcaaatgagataaacgacatatgcaataacaatatggatacagatataaatggtatagttgtaaggtttgaagtaaattttttaggaaaaccattaaaacatggaggtatttatccatttagaaaaatgattgtttataaaaaggataaaggattcatggaagaccgtaatatggatgaacacatagtattgattgaaggaaaatcagttgaaactcattttgattcatatcatcgtgattataaggatttatctgtttggatagacaaacataataaatattcttcaagagaagtacaggattattttgtttcttcatcaaaagatacaaaagtaaaacttaataaatcagcgaaaataaagagatttattaagtttagtatttattataaattaccgatgggatttagagcaaaactctattatatttatcgttattattttaaattaggtttcttggatggtaaagaaggaaaaatatttgcttttcttcaagcgtactggtatagatttttggttgatgcaaagatatttgagaaacagaaagaagaaatgagatgaaaaaaatattaatacttatggggaggtatcttcctggatataaagatggtggacccgtaagaacaataaagaatttaacagattgtttaggtgatgaatatgatattaggatattaacaaatgatagagatcatggagacataagttcatattctaatattgtctatgattcttggaatcagattggaaaagctaaagtgtggtatgttaagcctaatggttttaaatttaaacttattcaagaattatcgaaaaatatagatgttatttattgttgcggaccatataatgattatgcaattaaacttatgttattgaataagtttaatatgattcgaaaaaaagttgttattgcatcaatgggatccttttcaaaaggagcgttaggtatacatagtataagaaagagtctttttattaatatgatgaaaatatttggtttattcaaaagtatactttggtcagttacttctttagtcgaagaaagagaattaaaggaaattataggtcaaaatgctgaatgtatgattgctgaagatttacctagaaatataaagattgagcataagcgacaaaaaaatcaacatgaattaaaaattatttttttatctagaatatgtgaaaagaaaaatttactatttgcaattcaagtgttaaagaaaataaataaaaatgtaacttttgatatatatggaaatatagaagattcagtatattgggaaaagtgtaagaatgaattaaagaattctttaataaattggcattatatgggtgaatgtgattcagaaaaagctcctgaaacatttggagattatgatgtttttttatttccaacatttggagaaaattttggacatgtaataagtgaatcattattagcaggatgtattccagttattagtaatacaactccttggttagattttgatagatacaaatgtggaaaaattgtttcattaaaggatatgaataaatttattgatattattaatgagttcattgaaatggataaagaggaatttaatacttatgtcaaaaatgctcaacaatatataaatagtaaaaatcaagagagtattaaaaatacaggatacaggaggatatttggatgagagttttatttttaacaaatataccttctccataccgtgttgatttttttaatgaattggggaaactgtgcaaactaactgtattatttgaaagaaggcaagcaactgatcgagaatggaacgttgataaaaatctaaattataaggctgtatttttaaaaggaaaatccataggtcatgatactgctatctgttttgaagttttaaggcacttgaataaaaaatatgatcgtattattgtaggtggatatagtacaccaacaggaatgttggctatacaatatttaaatttaaagaaaataccattttatttaaattgtgatggtggatatattaaacatgaaagaaaaataaattatttgataaaaaaatattttataagtaaggctacatattggttaagcactggaaaagaaacaagccaatatctattacattatggagcaaaaaaggaaaaaatatatgtttatcctttcacgtctctatataaaaaagatattttaaacaaaccattgaatgaagtggaaaaagaattattaaaaaataaattaagtataagtgacaaaaaaatagtaatatttgtaggtcaaatgatttatcgtaaaggaatagatgtattattaaaagcaatttataaattacctaaaaatatttcattttacattgttggtgggaaaccaacagaagaatatcaaaaatatattaatgaatatcacttaaataacgtttttttctttgagtttatggataaaaaacatttatttcaattttatcaaatatctgatatttttgttttaccaactagggaagatatatggggattagtagttaatgaagctatggctaatggcttgcctgttatcacaacgaataaatgtgtagctggaaaagaattgatcaaacataatgggtatattattcctgctgacaatattaatgtacttgcacaaagcatatatgaattaataaatgattctacaaagatttgtagtttttcaaaaagatctcttcaaataattaaagattatacaatagaaaatatggcaaatattatttttgatatattaaatatggggtaatgatatgaaattaaaagaaaaaaaattatttttgaatattaatgagtatatcattattctatttattttaagtttatttcatcctatatttggatttatattttacattggatctttaaaattgattcaaaaagaaaaagttataggtgctatcaaatatatgatcattgttacaatgagggatttattaagcagtgcgtctggagcatcactaggaaatttaaatacattaaagctatgtattattctggttatttctttgtacatattaaaactaactttttataatataaaatcccaaggcataaaattgattctgttttttacgatgttgttttgtatatatgttacattaacaagttttatttccagtagttatccgattgtttcaatatttaaagtctggagttttggactgagttttgttgcaataatttatggcatatattatacaagaaaagaaatagattggctctattatatattttatgtattaacacctttttttgttatcagcttttttataattccttttggaaaatttagacttgttaatgataattttcaaggtgtttttaatcatgtaaatttaatgggaattatgggaacgttgtatatatcagttttattaaatataaagaaaaataaaatggatatctatacaatattaattgtacttattctatatatgcaatatctaaccgcgtcaagaacagggatgtttgtttctatatttattattttcatacattttttgatgaatataaatgtgaaaaaagcaatatattttttaatgattggtacaattgtattttcattttattattataattcaacaataaaaaatatagtaaatacagaaatacatgaatatatttacaaaaataatacaaatgatattttatcatcaagaagagaattacagcaaaattctcaagaaaaataccaaaataatcctttaattggttcagggtttatggtgccgtttgatcaagcggttcaggattatagttttaatatgtctataatctatgaatcaggtaatttattttgggaattaattgggggtattggaataattggatttgtgctgtttatattattaattgtattaattttatgtagaggcaatttagagcgtatttcattgattttatcttcaataggtgtatgtttaggggaaatggttttttttagtgttaacaacatagcagttttattatatgttttcattgcaatttttttaattaaaccttatacgaggagaattataaatgaaaaatagattattatggatagatgtatctaaaggtattggtatttgtttaatgtattatggacatattggttgtccgcaatttattaattcgttaatttatgcttttcatatgcctttattcttttttttgtcagggtatgtattatctattgatggtacttttgctaatttttttaggaaaaaatttttaagtttaatcaaaccattttttatatttggtatattagttattttatgtaatatgatcgttggtttgataacaggtaataattataattttttagagaattttttttatatgttgattcaattaaagggaacacctgctagattatggtttataccatgtatatttattagtacattaatttgttattttattgtgaaaaataacaaagttggcataattatatttttgttattaaatattttagcgtggatgaatatattgatttttaagatcaattttccatggtatgttgatacagctattatagcgtgtttttttatgataataggttttatttttaaagaaaagaaagttactttttatatgaaaagtaataaattgatttttttattaataatttatgtgtttttagtaaaattaaattcttattttggaattgtagatattgcattaaataagtatggaaatccttttttgttttatataaattcaatgttaggaatattgatttgtattaatatatctttatggataaaaaataaaaagattatttatattggcagaaattcattattttttatgtgtttaaacagtatctcgattaaattttgtactgttatttttttattatttcaaagttttataaacataaatacaactatgctaaatttatttattttattatgttctataacttttgtatatattatatcagtgacacttaataaatattttaataaattaatggttttaatggggttttaataccttatcgtttttatttgtttttatataattggaaaattagtagaaataattttttatgttatttatattttcaagtttatatatagcagtaatatgattgatgattgataaattttttaatatgcaatctaatctgatgtataataaattatttttcattataatcgtatgatgaaaatggtatgtgatggatattgagaaagtaggtgattatatgaaaattgcatttattacacctagtttaaagatgggtggatatgaaaaagtagttgtaaattatgctaatgaattggttcaaagaggacacacagtatatattttgtgtggatttttaaagggggaattacttgaacaaatagataaaaatataatagttttaaattttaattcaagattaaaaaaatttatatttccacttatttcttttctaaaaaaggaaaaggatttagatattctatattcagcatttagatggtataacagtatatctgttatagcaaaaaaaatttctatgaataagacaaaaatctatgcaagtcaacatggttttgaaaagcaaaatgtgattattagatttgttttaggtagaattataaaaaaagcagattatcaaattgctgtagcaaaagatattgcagaatttgaaaaaaaatcgttaatgatggaagcaaattttcacattctttataatcctgttatctttgaaaaccaaataatacatatggaaaaacatagatggtttgaagatgatgaaccagttattattatgagttcacgaatagagtatgttaaaaatgaaattctaggtataaaaatatttaatgaattacaaaaaaacgtatcatcaaaattgattgttttaggaactggatcagaattagataagtgtaaacaactagtaaatgaactaggattaagtaataaagtagattttttaggatttgttaaaaatccaatgggatatattgttcaatcatcagtttttttacatactgcaataaatgaaggatttggaaatgtgattgtagaagcgttatatgctaattgtcctgttgtcacgacaaatacaactggaccaatagaaataatttgtaatgataagtatggggtaaatattggcaattataacgatagagatataataaaaaatggtgtcatgaaaattgaaaagatattaacaggagagattaaatttaataatttaaaaaaacgggcaatagattttaatattaagaatactacagataaatttttagaggtatacaatgaaaaaaattaataaattaaaattaaaattttcattattcttaattaatcattttttatcaacaacaaaatattttgaattaaaaagatggttattaaattttgggaaaattcatgtaggtagtaatagtaaaatagttggacctttttattgtggaacagaggtaaagattaaaattggagaaaattgttggattgggaaaaacttacatatcgaaggtaatggtaccgttgttataaagaatgattgtgatctagcaccagatattatgtttgtaacaggtagtcataaaatcggaagtagatatcgaagagcaggtgaaggaacagaatataaaattattgtaaataatggctgttggattggtgcaagaactacaatttttggagatatttctataggagaaggctcagttgttggtgctgctgctttagttaataaaaatgttgaagaaaatgtaattgttgcaggtgtcccaataaagacaataaaaagattagatggaagagatgaaaaatgaagaagatatgtattgtagcagaaaaaatgttagtaggaggagtggaaaaatcgttactttctttgttgaatatgatagataaagataagtacgaaataactttatatcttttaaaaaaagagggagagttattaaatcaaattcctgattgtataaaaataaaagaaattaatttaccaaaagatgaaatagaagatatattatatggaagaaaaaaagctttaatttattctttaaaaaaatatcatttttttttatttgtaaaaaaaatgataagattaggtttaatttctttaatttctcgaagtgatgaagaaataagaatgagatactataaaagtattgaaaaaaaatttagtattccacaatgtgaatatgatgttgctattgattatatgggatatggtttattaaatacaatgtatgctagtaagataattaaagcagaaaagaggatatcatggattcattttgatccgttgataggaatgggggacttttcttcatttaaatattatttaaaggactataattatgttttttgcgtttcacaagaaattaggaacaaaatgattcaacttattcctgatctaaaagataagtatgttgttttttataatatagtagataaaaattatttattaaaagatgcaattatagggaaaacgtatgataagtattttaatggtattaaaattctttctataggtagagttgatcctcaaaagggatatgatattgcactgttttcaataaaaaaattagttaaagaaaactataatattcattggtatattataggtgagggaccacaaagaagagaattggaaaatttaatagagaaaaatcagttaaaagatcatataactcttttgggacaactaacacatccatataaatatttacaggattgtgatatttattttcaaccatcaagacatgaaggctatggtattgcattagctgaagccagagctttttgcaaacctattgtttcaagtgattttgcaggagcgagggaacagttgattgatggaattactggattgattgtaaaatgtgatgaacgagagttatatgtaagtttaaaaagattattagataatgaaaatttacgggaacaattacaaactaatcttaagtcaaatagcaatgaatatcataagcaaatgagtaaattatatagtatatttgaatcatgagaaaggatttttataatgaaaaagaatattttatttgttatgccgtactttaattgtggtggggtagaaactacacttgtatcgcttttagaaaaattggattatactaaagttgatgttgatttgctgcttattactaaaacgggagcatttttacataaaatacctaaaatggttaatattaaaatactagatattccattgtcagagtggaatgttttttatggaaataaaaatgctataaaaaaatatataaagaaattccattttatttatcttcttaaatatttatgttgcaaaaaatggaaattaactgaaaatagggaagaaaatgtaaaatattttcagcatgcatcacaagtgtttcctgtttataatcaaaaatatgatatagcaattgattactttgggtatgcaacatttacaactttttatgtagcagagaaaattaatgcgaagaagaaattaagttggatacacagtcgcttttcaactataggagcaaattattttgagaactattataaaaaatatgatgtaatcaatgctgtatctaaagatactagagatgatttcttaaaaataacaaatattacatcttcaaaagtacatattttttataatttgattgattataaaaatatacgattgttagcaaatagtatgataaaagaagatagcatacaaacaaataaatttaagatttgtacagtcggtagactagaaaagccaaagggaatagatatagcgatagaggtggcaaaaaaattaaaggaaaaaaattttgattttatttggtatgtcgtaggtgaaggtacagaaagaaattatttggaagatttgatatctcaatatcatttagaagatactttctttttattaggaatgaaagataatccttatccatatataaaagtttgtgatatttatgttcagtcgtccagatatgagggatactgtactacaactaatgaggcaagaattttagaaaaacctattataacaactgatgtatatggggcatatgaacaatttattaataatgaaaatggattaattgtttgttgcaataaaaatgaaatttttgaagggattaaaaaattaatgatagacgaatctttaagaaataaatttaaaatgaatttaaaaaaagtatcgtttgattatagtcaacagttaaaaatattttatgaatgatttctaaatatagcttaataatttttatttataaaatattaattataatagagaagaggtgtactaattgaaaaaaagtcttagagcgagtattgttatgtcttatatttctatgtttgcaagtattatagtttccttgctttatacaccagttatgttgaaatatttgggacaacaacaatatggtctttataatatggctgcttcagcagtaagttatttaaatcttttcgatttaggattggggaatgcagttattaggtattcgactaaatatcgaattgatggaaaaaaagaaaaagctgaatatatgtatgggatgtttttaataatttatttaataatagcagttataatacttttattaggaatatttttaatttttaatgcatctaatatatttaaagtatctactggttcaactggggagatgcaattaaaagttattatgtttataatgacagtgagtttagcaattggttttccaggaagtgtttttagctcaattattagttcatacgaaaagtttacttttttaaaaataacaagtttgatttcaacgattttaaatcctttaattatgataccattattaatcaatggttataaggctgtatctatgtcagctgtttgtttattgctaaattgtgtacttatttttatcaatattatatatacaaaacagtatttaaaagttactatacgttttggaaaactggatttatttttattaaaggaaataggcaactattctttttttatttttttaggagctattgttgatcagttatattggaatacagataagtttgttttaggagcggtatctggagaaaattcagtagctatttattcactaggttcacagattcatacatattatcagcaattttcttggtctattagtaatgttttttttccaagagttacagccatgattacagaaaaaaaaccaatttccgagttgaattctttttttaaaaagatagggagaattcaattttttgttctttttttaatattgtcaggtttttatgtttttggtaaagaatttattatatggtggggtggtatagaatatgaagaagcatattatattgcactaattgtaataacaccagcaactataccattaattcaaaatatgggagttcatattgttcaagcaatgaacaagcatgcatttagatctatatgctatgctattatagctgcaattaatgcagtatcaagtttctttttggcagaacaattcgggggaataggatgtgctgtttgtactgctgtttctttgattattggacatgggtttgctatgaattattattataataataaaataggattaaatattagaagattttggaaagaaattgtttatataattttattatatttaccattggttattgttacagcatatatcaatacatattttgtaactgacagaataagtatactattctttaaaattatattatatgctttgatttatgttgtttttggatattttgtggtaattaatcaagaagaaaaagagataataaattcttttgtaaagaaacttcgagggataatatgatatatcaaagaataaaaaataaagttatgcaaaatttaaataataaaatatggttaaacatagcacataaaaataaatttattaaagaaaaagctattttttttgaatcatatagtgcatctgtttttcaaggaaacgtatattatttatataaagcaatgtttgaagatgatggttttaatgattatgtattttatgttgcatctgttaatcctgaaattacaagaaatgaattaaaaagaaaaaaaatgtatgattatagagttaaaatagtcagatatttatcaaaagaatatattaaagaacttcatacatcaaaatatttaattaataatgttacatttcctatgaactttgtaaaaaatataaatcagatatatattaatacatggcatggaacaccattaaaatgtttaggtaaatcaataaagaatgatccatttattattcaaaatataactagagattttttaagtatagattatttaatatcaccaaatcaatttacatcattaattttaatgaatgattatatgataaaaaatattatgtatggaaaagtattagaaataggatatccgagaaatattatttttcagaataataaatattataaagaaattaggtacaaagaaagactagataataaaaatgttatattatatatgccaacttggcgtggtaatgcgtgtggttcaaagagaaaagtagattatatttctttaatggaacaattattagaaaaattaggtgatagttatattatatatttgaaactacatccattagatagatcatctcgtattccacattcaaaacttaaaatggttccagataattatgaaatatatgaatttttaagtgtatgtgatattttaattactgattattcaagtgtattgtttgattttgcaaatgcacataaaaaaatttatttataccaatttgataaggatgagtattttaaagaaagaggaatatataagaatgttgataataaaatagattttccgatttctaaaaatattgatgaattaagtaagcaaattttatttgatagaaaaaagaaggataatgttagtaaaaattttgaagatatattttgtttaaaaactaataactcaacaaaaactgttattgatataataaaaaaaaataatttattaaaaaataaaaattatgataatgctgttattttaatagttattatggataaaattacagataatgagttattaaaaataaaaagaaaatatgaaaaaaaagaaataagatttgtttttattccaactaaaaataatttgttttttaatactgtaacatgttggaaagaaattgattatttagttgctaataagagtgagaattatttgttaaaggaaaaattttttttgataatatcaagaattattaattataaaaatttaaataattattgtaaaaatatttttaaaagagaagaaagaagaatattaggttttataaatattaaaaaaatatatttttggggtaataaaaaagatatgccacattattttaaattatatgctttaaaaaaaatagaaaaaataattgaatagggggataagggtgataattttatttgttattttattgattttagttttatataaaataaaatttaatataaaaggtgaattttatttagactattgtgaacaaagtaatattctttcttggaaaggaatatttgttttgttgatttttatggctcatattagtgaatataaattaactacgtataacactttagataatttatattttattattaaacaaaatatgggacaattaattgtagtgtattttttgtttttttcaggatatggaatcatgtattctattgttaataaagggccacggtatgtggattctattttaaaaaataggttcataaaatctttacttcattttgatttgattattttactttatttaattgttcaattttttttaggacataggtttaaaattgaaataattttgcaatcattgattggatgggattcattaggaaatagcaattggtatatttttgcaatactgtttttatatcttgcaacatatataagttttaaagctataaaaggattaaaatatgaatacggattattaattaatacttttttaatattaatttatattgtaacaataagatactttaaacctagttggtggtatgatagtgtgattagttatatgtttggaatgtatttctttttttataaagagaaaattgaaaaaattataaataacaaatatatactatttattattgtttcaattttaggatttatattttctagaagaattaaaacgtatatgataagtttttgtttaaaagagtttttctttatcatgttcattttattgttttcaatgaaagttcgtgttaaaaataaaattcttgattatttaggtaaaaatgtatttggatattatattttacaaaggttacctatgatcattttttcatatttgtctttgaatcaaaatagttattatttttttgttatagtgtgttttgttatgacttctttattagtaataataataaactattgtcaaagtaaaattgatttgctttgttttaaaaactaactatatactaggaggcttaatatgaaaattttggtaacaggtgctaatggattcgtaggtaagaatcttgttagtacattaagaaatatcaaagatggtaaagatagaactcattgtatcgatatcgaagatatctatacttatgatcttgataatactatcgatgatttaagaaaatatacaagtgattgtgatttcgtctttcatctggctggtatcaacagacctaatgatgttaaggaattctatcagggcaatgcttcttttactgaatcattatgctctttattagaagaacatgataataactgtccgatactgatcagttcttcgattcaggttagtagagataatgattatggtaaaagcaaaaaagaaggtgaagaatatcttttacatcatggtaaaaagatggattcaaaagtatatgtctatcgattagctaatctgtttggtaagtggtgtcgacctaactacaacagtgtaactgctacatggtgttataacattgttaatggaatcgatatccagatcaatgatcctgatgttgaattaccattatgttatatcgatgatgtaataaaagaattcttaaatgcattagaaggacatccaactaaatgtagtgaaggaatatatgaagtatatcctgtacatcatgttaaattaggagaacttgcagatatcatcaaatcatttaaggaatcaagaggaacattgagtgtacctaatatgaaagaaggaagtttagagaagaaactgtacagcacatatctaagctatctgcctaaagataagttcagttatcctttaaagatgaatatcgatcaaaggggatcattcacagaatttttaaagacagaagagtatggacaggtaagtgtcaatgtatcaaagccggggataacaaaaggacagcactggcatcatagtaagaatgaaaagttcttagtagtaagtggaaaaggactgatccagtttagagatatctatagtgatgagatcatagaatatcaggtaagtggagataaactggaagtgatcgatatcccaacaggatatacccacaatattattaatatcggagaaagtgatatggtaacgataatgtgggcaaatgagagatttgatccagaacatccagatacatattatgaagaagtataaaaaagaagtaaaaagcacttctgttgaagtatataataatgaaggataagatatcgtattgcaacgatagaccgatttgggtattatatgcttaaggaagtgataaagatgatgatggaagttgttttaagtgaagaaaaagcggaaataaataattatgatattgatgaatgttataataaaatagataaatattttattagtagaggtgttaaaaaaacaggccttggtttttataaagaaacaaataaagattttagtacttttgctggtgcacaagcaggatttcctaatagtgagtggtttttaaaagtagtagaaaaatggtactgttggtatgaaggtgatacgatcgaatatcgagaagatgcattagaatcgtattatcgaataaaaaatagatatgcaaatttcttcaaaaagcagaaaagcaataaattttgatttaaatgatagtcttctaaaaaaacattatctttcaaaaaattacaaaaatggctggagagatattaaaagatttttagaaaaaagtaattttgtacaccgtcagtactcaggctatgtatccaaggattgtataacaatgagtgatgtattgaatttagtaacagaaatgtctaaacagctagtttggctaaaacaatgtgtcaaagaatttgatgtaacaatagttggagatcattatagtttattgctaaatatatttaataccaatagtaatctttaaacactttgattaaaattgtttaaaaaaaagtaaaaagcacttttaatgaagtatataataatgaaggataaaatatcgtattgcaacgatagaccaatttgggtatcatatacttaaggaagtgataaaaatgatgatggaaatggtattaagtgaagaaaaggctaaagaaaataacattgatattgatgaatgctatgaaaaagtagatcgtttttttaaaaaaagaggcgtcaaaaaattatctaaaagcgtgtacttaggcagtaaaaaagattttaatacttttatgactgcacaatgggatctaccggaatcagcatggtttttaaaaatagtagacaagtggtattttcgttacgaaggcaatacgattgaatatcgagaagatgcattagaatcatattatcgagttgaagagagtatccatggtagaaaagcaataaactttgatttaaatgataatcttctaaaaaaatattatccttcaaaaagtcataagaatgcttggcgagatattaaaaagtatttgataaataatcaatttgttcatcgccagtattcggggtatgtatcgataaacagtatgagcatggcagaagcaggaaatataattggaaaaatggctaggaagtggaactggctaaataagagtgtcatacagtttaatgtaactaatgttggagaagaatacagctttttagaaaaaattgaaaacgaaactaaagccagtaaaaatgagttttaaaactcatttttatcttatgttgaaacagttataaaaataaagatagattattagaagtaaaaagcacttttaatgaagtatataataatgaaggataaaatatcgtattgcaacgatagaccaatttgggtattatatacttaaggaagtgataaaaatgatgatggaaatggtattaagtgaagaaaaggctaaagaaaataacattgatattgatgaatgctatgaaaaagtagatcgcgtttttcaaaaacgtggaatcaaaaaaatatctaaaggcgtatatcagggtgttaaaagtgattttagtgtttttatgcaagtgcaatggtatttaccagatacgccatggtttttaaaaatagtagataagtggtattttcgttatgaaggcgatacgatcgaatatcgagaagatgcattagaatcatattatcgaatagaggaaagatatgccgactacccatggtagaaaagcagtaaactttgatttaaacgataatcttctaaaaaaatattatccttcaaaaagttataagaatgcctggcgagatataaaaaaattcttattaaaaagcaattttgcacattgccagtattcagggtatgtatcgattgacagcatgagcatggcagaagcaggaaatacaattggaaaaatggctaggaagtggagctgactaagtaaaagtgtcatgcagtttgatgtaactaatgttggcgaagaatacagccttattccccgaataaaaaaagaatcaggattaataaaagatgagctggcatagcttatcttttattaatggaaaaatagaggtagaaaatggaaataatgacagattatacaaatgtaagatggaaagaaaacggtaaattaaaattactgatcattgtcggaacaagacctgagatcatcagactggcagcagtgatcagtaaatgtcgcaaatactttgactgtattttagcacatactggacaaaactatgattataacttaaatggtgtgttttttcatgatttgaaattagctgatcctgaagtatatatgaatgctgtcggtgatgatctgggagctacagttggcaatatcatcaactgttcatataaactgatgaatcagatcaaacctgatgccttactgatcttaggagatactaacagctgtttaagtgccatcagtgccaaaagactgcatattccgatctttcatatggaagcagggaacagatgtaaagatgaatgtttaccggaagaaacaaacagacggatcgttgatatcatttccgatgtcaatctagcttatagtgaacatgccagaaagtatctgcatgaatgcggtctgccaaaagaaagagtatatgtgacgggatcaccaatggccgaagtattagcgaataatctaaaggagatagaagcatctgatatattggacagattaaaattaaaagcgaagggctatattttattgagtgcacatcgggaagagaatatcgataccgagaagaacttcctttcattattcaatgcggtcaataaaatggctgaaagatatgatatgccgatattatattcatgtcatccaagaagcaagaaaagattagaaacgagcggtttcaaattagatggcagagtgatccagcatgagccgttaggattccatgattacaatcacttacagatgaatgcttatgccgtggtaagtgacagcgggacattaccggaagagagttcatactttacaagtataggaagatcgtttccagcggtatgtatcagaacaagtaccgagagaccggaggccttggataaaggatgttttgttttagcagggatagacgaaagatcattattacaggcagtagagacggcagtacaaatgaacttagaaggagatcatggaataccagtaccagattatattgaaaagaatgtaagtactaaagtagtaaaattgattcagtcatatacaggtgtagtaaacaagatggtatggcggaaagattagaattgatttttatttaataattgatcaaaagataaacctggatatgttataatagctatatattttataagcaggtgataatatgttagttagaaaacactatttattttatggtagggtccagggtgtaggatttcgttttactgcttatcataaagcagtagaattggggcttaccggctgggtatgtaatttaccagatggctcagtagaagcttgttttcaaggtgaagaatctttgatcgagcgcttagtgagtgaaatgaaacatactcggtttatttgtattgattcaatgaaagttgaaaatttgactgtattgaaagatgaaacatcatttgaaatgaaatattaagggacaggtggcatacctgtcctttaatatttagataaaaaaattggaggtagtagcttttcgtaatatttgttattataattatagttatgaaaaaggagtactaaaatgctgataactgataaagaattaaagagaattgtaagcaataatagaaatatgcaaacaggacgacaatattatcaaaaaaattatgttaaaaagataaatatttattatgagccattgtttgaagattatgtaattgaaggaatagttgacaatggaagctatgaagataaatgtatgatttccgtcgatagtcaaaatcaaatttttgattatgattgtgattgttattggtgtacagcagattcagcatgtggacatattgcagcaattttattaaaagttcaagaactttctcctgataattttccatttgaatatcgtgatcaggaacaaaacaaagatagttttgcacagaggttggctgaaatacgtcgtaatcacgaagaagctattttaaaaggcgaaatggctacaacaaaaaacataattaatgattttaaagatactaaaatcagtgcctttaatttgatcaatcaggataaagaaatcgatttagagcccatgatagtagtaaggatcgatggggcatttataaaatttaaagtaggaaatgataagaaatatattattaaaaatatacctgattttttaaacaatatttctaataataattatgttgagtatggtaagcggctaggttttcttcataatattgaggtttttagtgatgatgctaaaaaaatcattgacttgatgaaatattgtctagttgtttatgagcggtattgtcatgaatattattacaatgtaccaaaaacaacaaatgaaattaagatcttgtcagaaagtatcgatataatttatgatacattaaaagatttaaaatataattcatcaatattaatttatcaggaaaatcaattaccgactattgatattaaggaatctggaaaatattttttattgaaaatagaaaatatagatcagatatgtggaaataaaaacatttataaaatagatgacaataaaataggggtaacaaaattagataataatggtaaagcagcaaaatttattcatcattgtttacaaaaaagagaattatatctcagcaaagaagatgttgatgattttcataaatatatattaaatgatattaaacaatattttaattttaccggagatgagttaactaataatatcagtgataatgaaatcttgactttatatggcgatatcaatgattctgaacaaatctgtgtatatttaaaaagtgaacaagataagcagatcatttattcatttgaccatgatggtaaagttacatcagtgaattttgatttaattgaaaattacttaaaagaaattagtgatgtagttgattacgaaaaacacgctatttatattaatttagaaaatgaaaaagcatatacttttttaaatcaaggattaccttttctagctgattattgcgaaatcatggttagtgaagcacttaaaaagatcggtaaaaaaagccagtttaatattagtgttggcataacgattgaaaatgatctacttgcaatcgatgttgaaagtatcgatatccctagtgaagaattagctgcagtattaagttcgtatcaacgtaaaaagaaatttcatcgtttaaaaaatggtaaattattatacttggattccaatgaattagaagaattagatgattttatgaataactataatttaaaacctaaaatgcttgaagatggacatttagatttaaatgtttatcgggcttttagtattgaaaataatgtagaaaatagtaagtatttgaattttgatcgtagtgatatttttaaagaagtaattaataattttagaaatattaaaaaaacaaattatatattatctaaaaattatgataatattttaagagattatcaaaagtacggttatcagtggttgcaatctattagtgcatacggctttggcggtattttagctgatgatatgggactaggtaaaacattacaaataattgctttattagatgaaaatcgtcatgctgataaaacaagtttagttatttgtccatcatcattactattaaactggcaagatgaaattcataaattctcttcaaatttaacttgccaatgtgttaatggttcattacaaaaacgaaaagcagcgatcgatgcttttaatgatgttgacattttaataactacatacgattatataagacgcgattataaattatatcaggatcatcagtttgaatatttagttattgacgaagcgcagtatataaaaaatcctaaaactaaaaatgctgcttcagtaaaaacaattaaagcaaagcatcgttttgcactaaccggaacgccaattgaaaactctttagctgaactatggtcaatttttgattttttaatgccagattatttattcaattatcactattttcaaactcactatgaaacaccaattgtcaaaaatcatgatgaacaaaaacaacaagaattaaaaaagttaattagtccttttatcttaagaagaaataaaaaagatgtattaacggaattaccggaaaaaatcgaaaagacaattactttagaattcaatgaggaagaacataaactatatttagctaatttagttcaagttaataaaagtttacaagaacaattaaattatgaaaaagtagatcgaattgcaattcttgcaatgcttactagattgcgccaaatttgttgtgaaccaagagtcttatatgaaaatatcacgcatatttcttcaaaattagagggatgtcttgatttaataagaaatttccagggaaataatcaaaaagtgctattattctcatcttttacagcagttttagatctaattattcaagaattaaaaaaagaaaatattagctattacaaattaacaggcgataccaagaaagaagaacgtcatcgtttagttaaacaatttcaaaatgatgagacaacagttttcttgatttctttaaaagctggtgggacaggattaaatttaacagcagctgaagcagtgatccactttgatccatggtggaatatgtcggctcaaaatcaagcaactgatcgtgcgcatcgaatcggacagcaaaatattgtgactgtctataagttagttatgaaagatagtattgaagaaaagatattagaattgcaaaataaaaagaaaaatctagctgacagttttgttgaaggtaatgaaggtacgattacatcaatgtcgactgatgaaattatcgaattatttaaagtatagctaattattaagttttaaaaatcagctattgatcagcgcttgacataaagtatactttagcttgtatactgattagggatgttagaaatgctagctaaattatggtaagataatgtatgaaggtgaaactatggaaaaattacaacaattaaaagaagtattgaaaacttatcaaaaagttgcgattgcttatagtggtggttgtgattctaattttttatatcaagttgccgcagaggttttaggaaaggaaaatgttttagcagtattatgtagaggaatcatgatgtctaaggaagatatcgaaaatgctagaacaatgcttgtagctgggtggtttgttgaagtgtctttagatgttttagccatcaaacagtttagatataatcgtaaagaccgctgttatcattgtaaaaagcaggtaatgtccatggtcatcgaaacggctcataagtttggcattgaaactgtgtttgatggtaaaaatgctgatgatgaaaaagtataccgtcctggcaatcaggcatgtttagaattaggaattatctcaccattagctaaggtcaaattaacgaaagcagaaattagagaatattcaaaacagttaaaaatcgctacatatgataaaccagctaatgcttgtctagcatcgcggtttccttatgatacattattaacgaagcaaaaattagctttggtcgaagcggctgaaactttattgcatcaaagaggtgtatatcatgtacgtgttcgagttcatgataaattagcacgaatcgaggttgagttaaaagactttaataaagttattgatgatgatgctttagttaaggaaataaaaaaactagggtttgattatgtgacattagatttggaaggcataactagtggaagttatgataggtaatgaaaaagatggaaatcgttattattgatggccagggtggcggaatcgggcgcagtgttattgaggcaataaaaaaagaaattgataatacttttattattgctgttggaactaatagtacagcaactaacaatatgaaaaaagctggggctgatgtagttgctactggtgaaaatgcaattatttataatgctaaaaatgccaagatcttaattagcccgattggttttgtttttgccaactcaatgtatggtgaagtttcaccagcgatggctaatgcagttagctgtagtgaggcgcagaaatattttatcccagtaagtaaatgtactggtcatgtattaggagttgaaatgaagtcaattcaagaatatatcaaagatttaataaatattttaaaatagatcccgagtacatgaagtactagaagaaacacagaagtgtttgtggaaagggaaaatatggatttaatttatatgcatatggcagatggtttgatttctgtaaaaattggttttatttttttaataattagttttattatgattgctttagcaattaaaaaaatcaaccaggaacatgatgatcataagattcctttgatgggcgtaatgggggcttttgtttttgctgctcaaatgatcaactttacgattcctggcacaggaagcagtggtcatattggagggggaattttattatgtctgattttaggacaatatccggcctttttatcactgtgttcggttttaattattcaatgcttattttttggtgatggtggactactagcactaggatgtaatattttcaacatgggagttctaccatgttttatcgcttatcccttaattgctaaaccaattttaaaaaagaatttaaactcatcacgagttattttagcgagtattttagcggtaatagtcggcttacaaatgggcgcttttgcagttgtattacaaactttagcaagtaatatcacagaacttccatttgcttcttttgctgctttgatgttaccgattcatttagccattgggttgatcgagggattaataacagcggcagttgttttatatgttttaaaagataaacgggaaattgttgaagcatcgatcaataataaaagttttaccatgcttaatttaaaaaaacagttactaacgtttggaatcttaactgtgttagttggtggcggtttatctttatatgcttcaagcaaaccggatggtttagagtggtcgattgaaggggtaacaggacaaactgaactaaaagctagtggtactacgaaagatgctctagccagtgttcaagaaaagacgacacttttaccagattataattttaatggtagtgaaagtaatctaggtatttctgtttcgggaatagctggtggtgccgcaactttgattttagttggtttgattggttatttagtggtaaagaaaaaatatgagtagttttaaaacttcattatcaaagtttggctatttggagcaattagcggctaatggtacatcatcgattcaccgtttgaacccgttattaaaaattattttaagtttgatctatattatttttgtagttaccgccaattattttgatgttttagaattgttaggatatttgggattaattattataatgatattgtggagtaaagtatctttttatagtttgttgaaaagaagtttaattggcttgccaatatcattatgtattggcatttcaaatctttttttcgctaatagtgttgttgatattggtggtgttttgatatcgtcaggagtactttctttgattacgatcgttttaaaaaatattttatgtttattggctgtctttttattgatggcaacaacaagatttgaaagtattgcttgtgaactagtacatttaaaagtaccatctatttttgttttacagctggtaatgatttatcgctatatttttttattagttgaagaagcgttgataatgatgcaggcatatcagttgaagaaccctaatattaataaaattgcttttaaagatatggggagttttttaggaacattattagtgcgaagttttaaacgtagtagtgaagtatataatgcaatgaaatgtcgtggttttgatgttagatcatcttatttgaattatgagacttttaaaatagaaaattattttttgatcatgatggttttaggaatgatgattttaataaaggtggtattttaatgattgaaattaataatttacaagtagtatttgataatacccttaaagctttagataatatcaatatatttttaaagaaacaaaaatgcatcggaattattggtgaaaacggttctgggaaatcgacattattattaagcattcttaaattagttgattaccagggagaaatcaaaatcaatgatctttatgtaaacaaagatacagttgctaagattagagctttagtgggtctcgtttttcaaaattccgatcatatgctgtttttaccaactgtatatgataatctagcttttggattaataaatcaaggatcaacaaaacagatgatcgatgataaaatcaaatatatcgcaaagcagtttgaaatagaagatctattaccacgaatggcaaatcacttatctggcggtcagaaaagaatcgtcgctttagcgagtgtagttataatggatccagaaattttattattagatgaaccatcagcatttctagatccaaaaagccggcgaaacgtcattaatacgcttaaacaattgccccagcagatcattctagctactcatgatttggatatggctttagatctatgtgatgaggtagtcttgttgaatcaaggaaaaattgctgctagtggtaatgctcatgaaattttaacaaaccaaacactactggaaaaaaacggcttagaattaccattaagatatcagaggtagattatgaaagtaaaagaaattttagaaaaagtagaaaatcatgaaatcacggtcgatgaagctgtgaatttgatcgataatcccattgattatgcaacgatcgactataatcgcaaacagcgtacaggagcttttgaagttatttatggtgctagtaagactaaagaacagctcgctggaattattaaaaatatgctagaacatgaacaaaaagaaattttagctacgcgaatcgatgccacaaaagcagattatttaaaaaaattatatccagaatttgtgtatgattctgaagctaaaacctttttattaaaaaaagaggcaaaaataaaaaataaaggaaagatcgtagttgtttgtgctgggacgtctgatttaccagttgctaaagaagcattaataacggcagagtttttaggtaatcatgttgaattgatctgtgatgttggcgtggctggaatccatcgtttatttaataagatcgatatcattaaacaggccaatgttatcgttgtagtggcgggaatggaaggagccctggcttcagtagttgggggattagtggataaaccggtcattgccgttcccacttcaatcgggtatggagcaaattttaatggcttgtcagctttattagcgatgttgaatagttgtgctagcggtgttagcgttgtaaatattgataatggttttggtgccggatatatggcgcatacaattaattgtttaggaggatagcgatgaaagtattatattttgattgtagtagtgggattagtggaaatatgaccctaggagctttgatggaattaatcgatgatcccgattatttacaaaaagaattggcaaaattaaaggtagatggttatcatcttcatgtttcaaaaacaaaaaagaatgggataacaggtacatatgtggatgtttgtctagaagaacatcatcatcaccatcatgatcatgaacatcatcatgttcatcgtaatctttttgatgtaaataaaatcattgatgatagtggaattgatggacaagctaaaatattagcgaaaaacatttttttaagagtcgctaaagctgaaagcaaagttcatcatgaagaattaatgaatgttcattttcatgaagttggcgcaattgactctatcgttgatataattggaacagcaattttaattaccaagattgctcctgataaaatctgtagcagtatcgtcaatgatggttatggttttattgaatgtgcccatggaatgatttctgtaccagtaccagcaacttcggaaatatttgctgatagtgatgttgtttcacgacaaattgatattgatacggaattagttacccctactggagcggcaatcattgcggaattaagtagcgcttttgggatgatgccagcaatgaaagttcaaaaagttggctggggatgtggcagtaaagatttaaaaattcctaatgtattaaaagtatcattagggcaaatgaatcaagatgacgatgaagttattgtcatggaaaccaatatcgatgatagtaatagtgaaattttaggatacacatcacagcaattatttgaaaatggggctcttgatgtctattacacaccgatttttatgaagaagaatcggcctgcttattgtttaagcgttatctgtgataaagataagctggaattgttacaaaatattatttttaaacaaacatcaacgatcggaattcgttatcgctatgaaaaaagaacggtattatcacgcaagatgatcgaaattgatagtccgtatggtaaaattttagctaaaaaagttgatcatgatggtaaaagttatctttatcctgaatatgagtcacttaaaaaaattgccaaggaaaatgatttaggaattaaagaggtttataagttgattaaataatagatatgaggagggagaaagtgaaaaaatattggcatcaaattaaagcaatctgttttttggcttggccagcagttgttcaagaagcgatgaatgtcgttgtgtcctatgttgatacagcgatggtcggggctttaggcgctgatgcttcagcggctgtgggtctgacctcaaccgttggctggcttgtttcgagtatcgctattgcttttggaattgggattctttctgtatgtgctcagtcaatgggggctgatgatcaagaaaaagttcaaagaacaggacaacaggctttatttttgactttgatagttggcactattcttacagtgatttgtgttttgattgcaccatatttacctatctggttaaatggtgatccagaaatttgtgcggtagcttcctcatattttatgattatttcgataccactgttgtttcgcagtgcagttttgattttatcatccgttttacgtagcgttagcgatatgaagaccccaatgatgatcaatctttatatgaatatgatcaatattattttaaattttattttgatttatccaacccgtaaaatatttggaattactgtttttggggctggattaggagtcaatggtgcagcaatagcaacagctatttcttttgttattggcggggtaatgatgtttgtcagatattataaaaataaaattttctcgttttctaaaactggttttcatttttataaaaaagagtttaaagaatgtctagatattggaatcccggttgttttagaacggggtgttatttgtttgggacatgtgactttttcggctctgattgcaaagttaggagtagctagatttgcagcccatacgattgcgattcaggcagaacaggctttttatatacctggttatggttttcaaactgctgcagccactttagctggtaatgcgatgggacaaaaaagtgaacaaagagttaaagaagtaacgtatttaattagtggtattacgatgctattaatgatagtttgtggcgtagtgctctttatttttgctagacagttaatgagtatttttactccagatgctcaagtaattgaattaggagctcgagttttacgaattgtttctgtttcagaaccaatttatggtattttggtaattcttgagggtgtttttaatggtatgggtgataccaaagctccttttgttttctcattattgacaatgtggggaattagaataattggttcctggtcaatgatcaatgtttttaatttaagcattgaagcagtttggatgatgatggtgtgtgataatgttgctcggtgtttcttgctttcaagaagatttttaaaaggacgctggaaatatcggttaaataatgattaaaatgcttagataaagagtatactataatatcaaaatgattttatggaggtaaaatggaattaataaaatattttttaacttttgaagctggtattatagtaggagtcgtgattatgtgtttatttcaaataatagatcgtcatgattgattttagtttctatatgaaatagaaactttttattatttatcttgacaagataaataaaataactatcttattacatataaaatataaaaaagagggataatatgagtaaattaaaaacgattataataactggagcaaattctggtttagggtttaagacagcagaaaatattgctaaaacgacagctgattatcaaataatcatggcttgtagaaatttagataaagcaaacgaagcaaaacaaaaactaatcacggaaactggaaataaaaatatcttagctttaccactggatttaacatcacttcaatcagtgcgggagtttgtcgaaaaatacaagaacatgaacttacaacctgtttatggtttgatttgcaatgcaggaatatcaggagttcatcagggacttacaaaagatggatttgattgtgtctttcaatcaaatcatttaggacattttttattaacgacattattattgccgttgatggaggaaaaagggcggattttagttgtcagcagtgatatgcattgtcctttaagtggtgaattagagtggcttggtagtgatgcgatagcttttcctaatgatgatcttggtaagcagacgatacgatattcatattccaaattgtgcaatttatattttacttatgaattatcacgtcaattaaaaaatgataaaaagcagatcatagtgaatgcttttaatcctggtttgatgttagagacaaattttgtcccagataaatctaagtttacaaaagaaagtttaaaagcagtatctgatcgagtaggttctttagaaaaatcatcacaggcattagccttgttgatgacagaaaagaaatatgaaaatataagtggtaaatactatgatagaagtacaaatacatgtgattcttcaccgctttcttataatcaagaaaacgctaaagaactatggacaatgagtatgaaatacacttataataaataatgataggaggaatcataatgttggaatgtggtgtaaaagctccagattttagtcttttaaatcaagatggcaaaaaagtagcgttgagtgattttaaaggaaagaagataattttgtatttttatcctcgtgataatacacctggctgtactaaacaagcttgtggatttggaaagttatatcctcattttacagaacttggtgtacaaataattgggataagtaaagatagtgtagcttctcataaacgttttgaacaaaaatatcaattaccgtttattcttttatcagatcctgaattagaagctattcaagcttatgatgtttggcaagagaaaaatatgtatggtaaaaaagttatgggtgttgttagaactacttatttaattgatgaagatggaatgatcataaaagcttttggaaaagttaaagctgctgataatccaagccagatgttagaagaattaaataaatcttaatatttgaggaatgagttttcattccttttttatataatattctatggattaaaattatagataataaaaatataataattaatcgaaaatcacattaacttaattgtcgtaaggtattaggatattaaatccttttttagtttatttctttcttgataagctaatatgtgttatactactagcgtatagggggatttatcatgataaagatgattgctacagatatggatggaacatttttagattctgaaaaacgttttgatccagaatttatagatatattttataaattaaaagaaaaaaacattaaatttgttattgctagcggtaatcagtattatcgtttatttcaaaaatttatacctttaagtgaacaaatgtatttcattgctgaaaatggaagtttcattgctgagggggcaagggaattatattgtaatataattgaaaaagatgatgttgaaaaaataaaagggcttttagcaggttataatgaactgttagtagtattatgcggtcgcaaaggggcttatattttagaaaaaaattatcaatataaagatgaaataaaaaaatattattgtaattatcgttttgttgaatcatttgatgacattaatgataatattatgaaaattgcggtatatgatccaaatgataagcttgatattgtgtttaatgaaattggatcaaagttgccagataatgttaagacagttacttccggtaataattgggtagatatccaaaataatgatatcaataaaggaattgcaatgcgctttttacaagcaatctatgaaatagaacctgatgaatgtatggcttttggtgatcagatgaatgattatgaactgcttaagcaagtaaaatatggttatgcaatggctaatgcagtagagccgatcaaagaaattgcttatggtattgcagatactaatgatagacaaggggtacttagtaaaattaaagaaatattaaagttatagcctattttattaggctattttaaataaaaaaacttttttacaaaagtttttttatctcttatttataactagacataattttccaattactctaaatccagcctgattatcacgattgataataagaggattataatcagggttggcaggttgcaagataatacattgattatcgttatcacgatagaactttttacatgttgcaacattatcttcaatagtaaagcagcctatttccccatttctgatctgattgcatttttcaaacacaatcaaatctccaggattaatattttcgccaaccatactgtcaccatttgcatattggcaaaagtattctttgtttaatgataataaagattctggtaaagcaatatattcatcgatattatcatctacaaaaataccggttccacaactgatatcattatataagggaattgttatagaattagtaagggtcggctgttcaggttcgtcaatacctaaaaagtaagaagctggtacttcaaatatttcagataatttttgaatcgtttctttttttaagttttcaacacgattattttcatatttagcaatcgctgatttttttacacctaaaagcttgccaagttgttcttgtgtcaagcttttttcttttcgtaatttttttattctctcaccagtcatttaaatcacctcttgtgtcttaattttactattaatatgttgtaattgcaaatgttattaacaaaaagtatctttaaaagatactttttgttgacaaagcaataaaaaagagttatattaaaagtgtcttaaaaagaaacttttaatataaaaataaaaaaagatgaattaatagatacattgatggagggaataacaatggaatatgaagaactaaattttacaaaaaaagggatcatgacgataatagttacaatattatcattagggttcgtgtttgcatcattaagtagttatttagttgatttaattgttttataatggggaatactaattaggggtgataattagtgaaacgtaaggataataaggataataaagagcaagatgagctagattatgataatcatattgttgaatatgacaatgaatatcccaatgcttctaatgctcaagaatagtcaatttaattgactatttttttaaatatttgatgaaaaatattttcataaaatattgttttgtgctaatatttattcatggaggtgtgataatggaaaaaactgtaatggatacgatatgttcattgtatgatggcttttttgattcagaaaagaaaattgccaagtatatcattaataactatgacaaagtagttgatatgacagtgggacagttagctaatgttagtggatcaagtgaagcttcagtatcacgtttttgtaaaaagattggcgttaaaggatttcatcatttaaagatatcattagctaaagagatggttgaaacaggtactggtgaagtagtgtcgatatcaaataatatttcaatcgatgatattggacaatctttgcaaaatatcttggctaataaagtagaagaactgaaacagacagtttcaatgatggatgaaacgaatttaaaggaaattttaacaattataaaaaatgctaaaagtgttcagtttgcagctgttggaaatacaataccagttgctatagatggagcttttaaacttaatcaaattggtattccagcgatatcgggaactatttgggaaactcagatcggttatacctataatttaacaaataaagatgctgttattgttatttcaaattcaggtgagtctagagaaatgattactttgatgaaggcagctaaagaggtaggagcaataacgatcgcgataacaaataatgagcagtcaactattgctaaagctagtaattatcatattactacagcaactcgtgaaaaattatttcttgatggttattgcttttcacgggtttctgcaacaaccgtaattgaaatcttatacttgtttttaacttcaatggataaaaatgcttataaaagtattgctcggcatgaaaatgctattgctggcgataaattttaaccaggttatacctggttttaattatttatatacatgaaataaaatttcttaataaaagtattgacgaaaatatgatatcgttgtatattatagttgtgaaaaataatttcgttgaaaaaggaggagtgaaaatgatatacacaattacgtttaatcccgcgttagactatgtcgtaagtgtcgatgattttaaattagggatggtcaatcgaacaagtgacgaagcaatttactatggcgggaaaggaatcaacgtagcagcagttttaaaagaattaggatatgaaagcgtatgtttaggatacttagcagggtttacgggggatgaaattcaacgtggagcccgtgaagttttaggattaaagacagattttattaaattgaataaaggtctatcaagaatcaatgtaaaacttcgtagtaatgaagaaagcgaaattaatggtcaaggacctgttattgatgaaaatgctttaacattactaattcaaaaattagataagttagtttcaggggatgttttgattctttcgggaagtattcctaaatcaatgtctaaagatgcttatcgcactattttaaaatcattaaatgatcgggatattaaaacagtggttgatgctacgggtgatttattaaaagggacacttgatttaaaaccatttttgattaaaccaaatgtgcatgaattagcagaactatttaatgtagaaatcaataaccttgaggaagtcgaattttatgcccgtaaattacaagaacaaggtgctaagaatgtattgatttcaatggctaaagatggttctttactaatagatgaaacgggaaagaaacatcaattaggtgtatgtaagggaaaattaaaaaattcagttggggctggagattctatggtagctggctttgtagctggatatttagatggcaaagaatatcacgaaattattaaattagcaacagcagcagggggcgcaacagcatttagcgaaggattagctaaaagagaaatgattgaagaattagtaaaacaactataaagaggagaaagtttatgaaaattacggagttattggatataaaaagtatcgctttaaatgtcaatgttaaatcaaaagaagaaacaattgactgtttagttgatttaatggatgcatcagggaaaattagtgataaagaagcatataaaaaaggaatattagctcgcgaaaaattaagtactacgggaattggtgatggaatcgcaattcctcatgcacaagtagctgctgtaaaaaaaccaggtttagcagctattacaattaaagatggtgtagattatgaatcattagatggcagtcttgtacacttagcatttatgatcgcagctcctgaagatggcgggaatcttcatttgcaggcactagcaaaattatcaactttattgatgaatgaagattttagaaaagcactgatcaatgcttcaacagcagcagagtttttaaatataataaatgaagaagaagctaaaaaagatgctgaaagtacccctaaagaaaatgggacatatcgagttttagcagttacagcttgtccaacaggaattgcccatacatttatggcagctgaaaatttaactaaagctggtaaagaaatgggatatttgttgaaggcagagacaaatggcgctgatggtgctaaaaatgttttaacggctcaagaaatagcgatggctgatggtattattattgcagctgataaaaaggttgaaatgtcacgttttgatggtaaaccagtcctttcggttagtgtaactcagggaattcaaaaaccagaagaattaattaataaaattattaatcatgaagtccctgtttatcatcatgatggcagtgtaaatgttgaagaaacgtcatctgaaggaatcggtcgagctatttataaacacttaatgaatggtgttagtcatatgttaccatttgttattggtgggggaatcttgattgctttagcattcttatttgatgattattcgatcgatccttctaattttggtaaaaacacaccattagcagcttatttaaagacgatcggagagcaggcttttgggatgatgttaccagttttagctggttatgtagcaatgtcaattgctgatcgtcccggcttagcagtaggttttattgggggaatcgtcgctaaaatgggttgtacttttgctaatcctgctggtggtgatgttaattcaggatttttaggagctttattagctggttttattggtggttatttagttttagcgctaaaaaaattattttcaaaattaccaaaagcgttagaaggaataaaaccaattctaatttatcctgttttaggaatcttattagtagcaattattacaactttgatcaatccgtttgtaggtgctattaatactgctcttaataatttgttgaatagtatgggtggaacaagtaaaatattattgggtatggtcgtagcagggatgcagtctactgatatgggtggcccaatcaataaagcatcatacgtttttgcaacatcacaattagctgaaggaaattttgaaatcatggcggcagttatggcgggtggaatgattccaccacttgcaattgcattgagtacgactttatttaaaaatcgctggactaaagaagagaagaattctggtttagtaaactatgtgatgggactagcgtttatttctgaaggagcgattccttttgcagccaaagatcctcttagagtcatcccttcttgtattattggttcagctgtggctggtggtttatcaatgttgtttggttgtactttaagagcacctcatggtggtatctttgttctaccaacgattgggaatccgctaatgtatgctttagcaatcgttttaggagcaattgctggatgtttagtattatctattttaaaaaaacctttaaaggagaataattgatcatgaaacaaagatgtgcacgagaagctttgaaattaataaaaaataatatgacgattggattaggcggtgggtcaaccatctcctatctagtaggttatataaaagaagcacagttagatgttaaagttgtaacaccatcactatcgactgctcaattatgcattaaaaatgggttacatcttttaccaacctgggctgttgatcatcttgacatcgcttttgatggatgtgatgaagtagatttaaagttaaatgctttaaaatcaggaggagcaattcataccaaagaaaaaattattgcctcaatggctgatgactatgttttattagttgatgaaagtaaagtttttgagcaattaccattgaatttaccaattgctttagaagtatttcctgaagcgttatcatatgttacaaaaaaacttaataatatgaatgctttagttgaaattcgtccaacatctagtaaagatggcggaacgatcagtgataatggcaattatattttaaatgctaagtttgaaaaagttgaagatttgaaaaaattaaatgatgatttattagctatttgtggcgtgattgatacttctttgttctataatattgccactaaagcaatttcagtagatcaagaaggtagtagagtgatagtgaaataggaggatgtaaagatgaaaaaatataattggggaattttaggaacaggctggattgctcatgaaatgggtgatgctttaaaaagagtccatgatgaaatttatgctgtttgtgatgtaacgatcgaaggagctaaaaaatatcaagaagaatatggtgttgttaaagcttatggaaatgtagatgagatgttagatgatgaaaacgttgatattgtgtatattgcaacacctcataatttacattatgaaatgatgatcaaggctttaaataaaggaaaacatgtattttgtgaaaaagcgattactgtaaatgagcgtcaattggaagaagctgtagcaattgctaaagaaaagaatttaattattagtgatggaacgactttattgcatatgcctttatatcgtaaagttaaagaaatcattacaagtggtaaattgggtaaagtaaaaatgattcaagttaattttggatcatgtaaagaatatgatgtaaaaaatcgtttcttcgctaaagaattagcgggtggagctttattagatatcggtgtgtatgctgtatcatttgctcgttattttatgactagtaagcctaatgttgttttaacaactgctaattattttgaaacgggagttgatgaaacttcaggaatcgttttaaaaaatcctgatgaagaaatggcagttatttcacttacaatgcgggctaaacagccaaaaagaggaatgattgctctagaagaaggttatattgaaatttataatttccctcgtggcaataaagcaacgattacttatactgtagatgggcatagcgaagtaatcgaattaggtgatactgatctggctttagattatgaagtaaatgatatggaaagatatattacggaaaatggtggtaaagaaaatttaacctatgtccgtgatgtcatggctactttaacagcaattcgtaatcaatggggtatggtatatccgtttgaataatggaaatacggcagactgcttatttggaattgctggctaatagatatcctagtcgagaagctgtaattgaagaaataattaatttaaagatgattctatcaatgcctaagggaacagaatattttattagtgatattcatggtgaggatattaaatttaggcgtatcttgaataactgctctggcgttattcaagataagatagaaactatttttaaagatctatcaaaagaaaaacagacggctttatgtatgttgatatatgaaccagaaaaaacaattgaaaaagtaaaaaaacagaataattggaattattatcatgaaagtttaatttatctagttcttttagctaaagagttgagctctaaatatacacgttcaaagcttaaaaaaatgtttagtaaacaatacgcttatttgtttgatgaattgttaaatggtcaaaacattaaaaataatgaacaatatcatgaaataattgaaatcttagcaacggttgataaatgttatagctttttgatcgaaatgtgtaatttaataaaaaagctggcagtagatcagctgcatatcttaggcgatctgtatgatcgaggaccacgtggcgataaagtgattgatttgttaaaaacttatcattcggttgatattcaatggggtaatcacgatattttaatgattggagcagcagctggaaataagtgttgtatagcgatggtagttttaaatgcctttaaatatgacagcttagaaatgattgaaaatggttatggcattagtttgaaaaaagtatttcaagaagcacgatcattatatccagatatgtccatgattgctgcttgtaaaaagctaatggcaataattatgtttaaattagaaggccaaattatcatggctcatccagaataccaactgaatgataaattatatcttgataagatcattaataataaaataaaaatcaataatcatttatattcattaaatgatagtgattttaaaactatcgatcctgcttgcccatatcaattaaatgatatagagactgaaattattcaagaattaaataaaaattttaaaaatagtcccaaattacataatcatattaagtttcttttaaataacggtagtgtctataagatatgtaatcataatttattgtttcatggatgtatccctttagatttttatggtaattttatacctgttgatttgggtaatcaaaaattagcggggaaaaaatattttgattatttagatcgtaaaataagaagcggttattttgaaaaagataaagatgcaattgatttatattggtttttatggtcaggacggctttcaccattttgtggtcgtgatcttaaacactttatacgaatgtttgtcgacgatccaaaattaggaaaagaaagatctaatgcttattacatgtatttaaatgatgaaaatgtatgtatgaagattttgaaagaattttcaattaataatggtcatataattaacggacatacgccagttaaaattaaagatggtcaatcacctgtcaaggcaaatggaaaactggttgttatagatggtggttttagtccccaatattataatcaaacggggaattcgggatatacattaattagtgattcatatggtttaatgttaagaagccattgtcatgaaattacatggcaaacgactttaaaagatgaattaatagaaaaatattctaaacggttattgattaaagattgtgataacggtaaaagaataatggaaagaatcaaagatttagaattgcttttacaagcgtatcgtgatggggtaattcatgatatgatgatcagtgatgaagaaacactgaattgataaaaagagtattaattgttatttgttattaaaaacatgagttatttgaatgactattaattaaaaatgagatggcacgtattttgtgtgatctctttttggttttaaaagaaaccagtgatattcaaattcgatatatttgagaaactttcataatgtgcatcgaggaaaattgttgtattgcattttaacagtaccgatttttacataatatttacattttagatatattttagttttatctataattatgatttaaaaaaacactaaaaactgatttgttgataaaatatttttatttttaattaggaattgaaaaattattatttaagcgtatcgtaataatgctattcgtgatataatatttaatattgaaagcacattatgttgagcagtttagaagtatttaatcatatattataatttagggtactgtaaacaatgcctgttttaggctttttttgttgaattaagatattttgaaaagatgataaaagtgttgtttatttaaaatttgggagggaatagttatggatgagttttatcaggaaatcaatgcgatattttatttaaagtggatcatgattcaaggtgaaaaatataatttgaaaataaaatatgctgatgaaaagcaaaatgttgttattataaataatgatgcagtagaagggaaaataatttattatggtgatgggatatttgaacaagaattgattgattgtcaaaatcataagaaaatattttacttacatttccgattgactcatttgaatcacgctgttgaactgtttaaagaaatggctaaatgtgctgttgatgcaattaatagaccgcagcttcgaattttactttgttgcagcggaggtttaacaacaagtttatttgctagtaagatgttggaactggctgaatttgaaaatctcccttatgaaatttcagcagttggctatgctagattatttgaaatagccgatgactatgatgttatcatgttagctcctcaagtaagttatttattaccgcaagttaagtgtcgtttagaaaacaaagaaattttaactattcctgtacgcatatttgcaactaataatttttctggggctttaaaactgatcagtgatatatttgaaaataagaagatgtaagtgttcttttaggatgatagaaaagtgaaaaaggatcaagattttgtagtaattaactgcatgtcttgattttttgtttgatgttaattaaattggatgcgaatgagtttttaattataatcttgttagtaataatatatttacaaatgttttaaataaaagatgtttttctggtaataatttaaataggtgattttgtgttagaagaagatattgaattattgatcatgtgtttaaaggaatatataaaagatgtagatggtgaagaatttaaaaaaatttttttaggttatgtagaatatatggctagaaattacgatcaagattgtattattgatgaatatgatcaaatgatgcaagcaacaacaaggtttgtaaataagcatcatttaaatatttataaattatcaccatttaagcgggatttattgtgtcgatgggtaaaggctggttatgaagaaaatgatattttaagattatactattttaatgataaatttaattctttggaagtatttattgagatgattgaaaataagtacttgtaaaagataataattttggtaagatataggtgaaagtgggtggaaggatgtataaattttcttgttaaaacttaagataacagttgtattaatactgttttttgtgcgcaagaaaatatatccttaaaaatattaataatctaatattctttttagctacgagtatatattttcttgtagcttttatattgttaggagggatattagatgggtttattagaggtaaagaatttgacatttggttatgatgatcagattgaaaatgtttttgataatattagctttcaaatcgatacaaattggaaattgggattgattggaagaaacgggaaagggaaaacaacattattaaatttgtttagaaataaatacgagtatcaaggatacatcagctcgggttatgtatttgattattttccttttgcactcaaagatgaaagtttaaaaacaattgaaattatagatgatattttaaatgattatgaactatggcagatagaaagagagttatcattgttagatgttgaagataatgttttacagcaaagctttgaaacattatctaaaggccagcagacaaaagtattattagcaatattatttttaaagcctcatgatcttgttttaattgatgaaccaacgaatcatttagattatcatggcagaaaagttttatgtgaatatttacggaagaaaaagagttttattttagtgagtcatgatcggaattttttagataattgtattgatcatgttttatccattaatcgtaataatatagaaattattaaaggtaatttttcgctttggtatgaattaaaaaataggcaggatgaattagaacgccaaaaaaataaacagttaaaaaaagatattaaaagattacaacaaagtgctaggcaaaatgaagactggtcaaataaagttgaagcaagtaagaatgtgaaagtttcaggacttaaacctgataaaggatatgtaggtcataaagcagcgaagatgatgcagcgctgtaaaaatgtcgaacgacgtcaaaataaaatgatcaaggaaaaaaagaattattaaagaatgttgaagtaatcgaaaaactgaaacttgcgcctttaaaatattcaaaaaaatgtttatgtcatttagaaaatattaaaataatttatgatgatagagtggtagtagaaaatattagttttgatataaatcaaggggagcgaattaatttaacgggtaaaaatggttctggcaaaagcagtattataaaattaattatgaatgaaatcaaagattatcaaggaaaaattagtttaggtactaacctaaagattgtatatctttcacaagatgatagtgatcttaaaggaaggttggacgattttgctaaaaaatatgatttagatattagtctttttaaaactattttacgaaagttggatttttctcgggatttatttaaccaagatatagctacttatagtaaagggcaaaaaaagaaagtgatgttagcaggatgtttggctaaaccagcacatttatatatttttgatgaaccgttaaattatttagatatttttacacgaatgcagattcaagaattgttattagaattccagccaactgttttatttgttgaacatgatcaatatttctgtgaacgaatcaaaacaaaaacaattgcactattataattaatgaactacagttaattttaaataaatttaaaattttaatatttttatttattggaattatagtataatatattatagctagttaaaaaggagaataatatgatgaaaaaaattataaaattactttttatattttttattgttattggtataactgcttgtgctaatgaagaagaaaacaagacgttatccataaaatggggtaaagaaaataagtttgatggattaatttcttatgaattagaaagtattagcagtccccagcagattacgcctgattcactaggaacagtttatactttttataaaccgcaaaaagattctaacgtattattagatgcagttgtcagtgtaaaaaacttaaaaactagtgatttaaaaattgataaagatcttagtgcttcatttatgattggagaagatgagtatattgcatcggttgcaactgtaagcgaagatggaagttcattgaaagataatggtgtgattgccagtgaggcaataagtaaagtgcatttttatgcagaaattagtccgaaaaagttaaaagatgagattgaatttaagttgacaacaaaggatgaagaaaatcctcaaacagcagctttaaaatttaagttagaagatgtaagtaaaaattatgaagtgaaaaatatgaacgatgccattacgattgaaaaccgtagtgaaataattttacagtctactaatgttactaaagaattagcaccagctaatcctagtgggttatatactttttataaagtaaatgaagatactgatagttttgtagttttaactacttctattaaaaatatttctggtggtgatttaactgcaggcagtgttgctgcagcaaaattggtagataaagatggtaatgaatatccagctagtattttttgtgaaaatgaagcacgtagtgatttgactacaggtaatgaaactgtaattggtgctgatcaaagtataatggtacattttgcttttgaaatgccggatgaaattattaataatgaaaagatggttagaatctcatatcagggtaaagtatttatagttaatatttaaatattaggttaatataaagaaaataaatggtaaaattttactaaaattatttatgtagtatcttataatattagtaaaaatattgacataaaaaataataagatatataatataggtggattgttactttgagtaggcaagaccaaatactgagtgtactttttgtgcgtcggtatttggtctttatttttagtaactattgaaaggagaaaaaggatgcaaagaaattttaaaaagaaagttttagtgtcagcactgactgcttcaatttcgataagtacaatagtacctgggatgatggtttttgccaataattcaattgccactgctagcattataactaaagtaaatcatgctttacaaggtactgctactgcaaatgatacagaaatgagctactggggtgctgataaagcgattgatggaatcgtaaatcgtgatgatagtaagccagatcagtcacgctggtctactaatcagggtacatcaccaaagatcttaactgttgatttaggatcagaaaaatcatttagtgaatttaaaattgaatgggaaagaacaaatattaaaggttttaatatcgctatttctaatgatggtgaaaattacactactgtatatacaaaaccagatgatagtaatattccaagtttaacgacagaaattactttagaaaatagtgttttagcacgatatgttaaattaaccgtagataattatgatggtggtgatattaactgggcttcggtatcattatatgaatttgaaatcttaggtgaagaaacatatgaaaatttagcattagatgctacagcaacttcaagtggaaatgaaacaagtaatttcactgcggataaagttaatgatgaaaatatgactactcgctgggctagtacagctaatcacaatgatgacaagtgggtatgcttagattttggtagtactaaagatgttgcttcggtaaccttaaaatgggaacgccgtaatgcaacaaattataaaatacaatcttctaatgatgggactaattgggaagatgtgaagactttaactagtgcaccagctgattttgatgatgtcattaattttgataatacaataactgctcgttatttaagagtattagttacagattttattgattcagcagctgatcgtgaagatcaaacagtaagctggccaacagtttcattatatgaatttgaagcttatgcaattaaacaacaagcaagcgttgaacctgaacaaacaatcgatagtgttattgctaatttggtaattccagcaattgctaaaggagatactaaaatggcattacctgaagtgcctgatggattcgaaattgaatttgttggagctgattatgagcagatcttagatcgtgatttaacgatttatcaaccaatcgttgatacaacggttagtgtaaactataaaatcaaaaaaggtgatcaagaaaaaactactaacgcttatgaggtaactattcctggtaaacatactgttcaagaaagtattaatgctaaaccaaaagtagtgccagaacttgctgaatgggtaggtactgaaggaaattttgaaataagtgataattcaaaaatcgttatcaatcctcagtataaagaagatttggcatatcttgctaaaacttttaaagcggattatcaagatttaactggtaaggaaatagaaattgtttatagtaatgcaccagcagcgcatgatttctattttactttgggtagtgatgatacaggattaaaagaagaaggatatttaatgacgatagatgatactgttaaagtagaagcgattgataaagttggagcattctggtcaacgcaatctattttacagatcttaaagcaaaataataacgttattccacaaggacaaacacgtgattatccaaaatatgaattacgaggattcatgcttgatgttggaagaatgccattttctttggatttcttaaaagaaataactaaaaatatggcttattataaaatgaatgatttccaagttcatttaaatgataattatatcttcttagaagaatatactgctgctggtgaagatccaatgcaggcttattctggatttagattagagtcagatgttaaaaaaggtggtaatggtggattaaatcaagctgatttaactaatactgatatgttctatacaaaagatgaattccgggctttcattaaagaatcaagagaaatgggaattgatattgtaccagaatttgatacgccagctcattcacttgcatttactaaagtacgtccagatttaaaagttggtgataatgggcgtcaaaatgatcacttagatattaataatccagacactttaccatttgttcaaagtatttgggatgaatatttagatggtgatgatccagtatttgatgatgaaacaattattaatgttggtactgatgaatttgaaggatataatgagcaattccgtaaatatactgatgatatgatcgaatatggtcaaagtaaaggtagaacagttcgtttatggggaagtttgacacaaaaatccggatctactgcagtacgttctgaaaatgttcaaatgaatatctggaatacaggctgggctaatccttcggcaatgtataatgaaggttatgatttaatcaatatggttgatggaacattatatatggttccagcagcaggatattattatgattatttaaatagtcaaaatttatataataattggcagcctaatatcatgggtggaacaacgattcctgctggagcagagcaaatgttagggtcttcatatgctgtatggaatgatatgatcgataaaagagccaatggtatgagtgaatatgatatttatgatcgttttgcagcagctctacctgcgatgtcatctaagttatggggtgatggtgaagacttaagttatagtgaactagtacaagtgacagataaattagaagatgcaccaaatagtaatccatttgataaggttaaatctgttagtgatacagtaattaattatgattttaataaagaagatattactgataaatctggaaatagttataatgctgttactaagaaaaatgttgctactgtaactggtaaattctctaagggattacaattaaatggtggtgaaagttatattgaaacaccgattgataatatggggccaactaatagtgcttctttctgggtaaaaatggatccagatgctcaaggtgaacaaatcttatttgaatctgataaaggatcaattaagattgctcaaaaagatacgggtaaagtaggattctcaagaattggttatgattattcatttgattatactttaccaaaagatacttgggtaaaattagaaatcaaaggatatcaaaataaagcagaattatatgttgatggggtattagtagatactttatctaatagtgcaactggtggtaaatatgcgacgatgatcttaccattagaaagaatcggaagtaaaacaagttcattcaaaggggtaatcgataatcttgttgtttcatctaccggaagtactgctagtcaggattatacaataatcgatagtaaaaactttactgtaacatcagataatcaaaatccgcttgctggatcagaaggacctgtttcattagcgtttgataatgatccaagtactttctggcattctaattacacaccatatcaagcactaccggcaactgtggaaattgatatgaataaagtgtataatattaatcaatttgattatttaccaagacaaactggaagtaatggtcatattacccaatacgaattatatgttaaagaaaatgaaactgatgaatatacaaaagtttcagaaggaactttagcagctaattcaacattaaagagtattgcttttgatgctgtaaatgcccgttatgttaaatttgtagctttagcaggaacaggtgttggtacacaacaatttgcagctgcagctgaatttacagttcgtcaaattgataataaagctgatttaagaaaactagttaatactactgaaaattatgaagaagaatattatactgaagcaagctggcaagcatatagtgaagctttagcgttagctaatcaaattcttgataaagaagatgcaacagaagctgaaattgctacagcaatcgagacattaagtacagcaattaataatttggtagaagttgatacagaattagaaacagataaaacagtattacaaatagcggtagatactgcaaatacattaaaagctcaaggagctttagataacgttgtaccagcggtagttaatgaatttaatgctgctttacaagaagctcaaactattttagctgatgtaaatgctagtcaagtagtaattgatgcatcatttacacgtttatcaacagcaattcatatgttggaatttgtaaaaggagataagactgctttagaggccttgatcaatgaagcaaataattatgtagaagaaaactacacaccagcttcatggacagcattcaaagaagccttagatgctgcaaatgatgtaatggctgatgaaaatgcattagaatacgaagtagtagaagcattaaataacttaaaagatgcaattggaaacttagtaatcagagttgataaaacaagattacaagaagcatatgacatggtaaatggcttagataagagtctatatacagaaggaagtgttgccaacttagcagaaccaatggcaaatgctaaagcgatattagataatccaaatgcaacacaagaagcagtagataatgcatatgaagcattgatcagagcatacttagacttaagattgattccaaataaggatctattacaagaattgatcaataagacaaatagcttaaatgcggcaaattacagtgctaagacatggtcagtggtggcagaagcattggaaaaagcaaatgctgtattaaatgacccagaagcaacccaggcagaagtagataatgctaaagaagtattaacaaaagcaatggccggattagaagcaaataatccagtaaaagctggtgatacaacagcaagtgtagctactggtgatacaacaagtatgttatatccatttgcaggattagcagcagcatctattgttttctatggtagtaagaaaaagaaagaaaaaaattaatagtttaaagaaatttatatattattagggtacctatgttgaggtaccctaatttagtatattttggataattttataatagattatatatgtaaaaattttaaattattttagcacttgtgttgacaaagtgctaaaatagagtataatggttttagcacttagaaatggcaagtgctaaaaaaggagtgattaaaatgattaagccattacatgataatgttattttaaaaaaagaagaagtagaaaataagacatcaagtgggattattttaacaaccgaaactaaaaagattccaagtgtagcaactgttgttgctgtgggacctgaatgcaaagcagaaattaaagaaaatgataaagtagtatataaagaatattcaggaacagatattaagattgatgagatagattatattgtaattagtgaaaaagatattttagcttatattgcttaggaggtaatttgttatgagtaaagaagttagattttcaagtgatgcccgtaaggcgatgttaaaaggtgttaatattcttggggatgctgtatgtgttactttaggacctaaaggacgtaatgttgttttagagaaaagttatggttcaccattaattactaatgatggtgtaagtattgctaaagaaattgaattagaagataaatttgaaaacatgggtgctaaattagtatatgaagtagccaataatactaatgatgttgctggtgatggtactactacagcgactattcttgctcgtaatatgatcaataatgggatcaaagcagttgataaaggatgtaatccagtattaatgcgagaaggaattgaatatgcaagtaaagaagttgctaaaactattttaaagaattcacgtaaagtagagactagtaatgatgtggctagtgttgcaacaatatctgccggaagcaaagaaattggtgatttaattgctgaagcaatggataaagttggtcgtgatggaattataaatgttgatgaaagtaatggttttgataatgaattagaaattagcgaaggtatgcagtatgataaaggatacgtatctccatacatggtttctgatcgtgaaaagatgcaagttgaattggaaaatccttatgttttagtaactaaccataaaattagtaatattcaagaaattttacctgtattggaacaagtacttcaagttaataagccattattattaattgctgaagattttgaaaatgaagttatttcaacattagtattaaataaactaagaggtactttcaatgtagttgctactaaagctccaggatttggtgataatcaaaaagaaatgcttcaagatcttgccgctttaacaaatgcaaaattctataacaaagaattaaatatgaaattagaagaaatgaaattggaagagttaggtacgatcaaaaaagtaattgttactaaagataatacaacaatgatcagtggtaacgatgctagtgatgaattgaaagaacgcatcgaagaaatcaaaacaagaattgctaatacaactagtgattatgataaaaaacaatatcaagaacgtcttggtaaattaacaaatggcgtagctacaattaaagtgggagctactacagaaagtgaattaaaagaaaagaaattaagaatcgaagatgctttaaatgctaccaaagctgcagttgctgaaggaatcgttatcggtggtggagctgctttagtagaagcttataatgaattaaaaccagtattaaaagatgaaaatgtagatgttcaaaaaggtattaatattgtaatggaagccttgttagcaccaatttgtcaaattgctgaaaatgcaggatataatgcagaagatattgttgatggacaaaagaacgctgctaaaaacgttggttttgatgctaaagctggtaaatgggttgatatgtttgaagaaggtattattgatccaactaaagtaacacgtagtgcattattgaatgctgctagtatttcagcgttatttatcactacagaagttggagtagcagaaatcaagtctgatgaaccagaaacacctgctatgcctggaggaatgtactaattatagaaataatcataaatataaatgaaagggaattagttaacgttactaattctcttttttatacagaatattaataattcatgatacaattaagtaaaggatcttaaggagggataatatatggggctaacgtttgaaggtatcatgaattattgtaaaacgaataaaataatatttaatgaaataaaagataacttaaataatattgttccttttgttggagcgggattatctgcttttgcatatccgctatggaaaaaagcattagaagatcttacagcatttattaataataaaaatactagagaagaaataaaggcactgatagataaaggacttcttgaagatgcggctcaagaaattgaagataaaagaggtaaacataatttagctaatgatcttttatcagtgttttcagcaaataaattagaagaagaaatcaatagtttatataagcaaaatgtttatttattgccatatatatttaagggtgcaataataacaactaactatgacttaataattgaaaatgtatatcgacaagttttaaataatttgaatatgccagttttattaccagggaagcctgaattaattaatcaatatttaggacaaagaaacagaccggtgatatataaagtacatggagaaattcaaaaagaagcaattgattatagttcaataatttttacaaaaaagcaatatgatgaaaaatatacaaaagatagtcaattagttaaagaactaaaaaagtgttttacaaacaatataatgttatttttaggctgtagtttagaaaaagatcgaacgcttgaagtgttaaaaatgatcactaaagcaggtattgatcattatggtattatctcatgtaaagaagatgaaatggatgaacgaattaagcaacttgcagaagattatcatattcgtgtgatttgttatcctgataataaacatgaagctgtaagaataattttagaaaaattacttgaagatattgatagagaaaaatatcaaagattggattatcatcttagcaaaatagatagaccgattgctaataggtttgtgtataattctaacttatttccttttgtaggaagaaatgaagaattaaaacttttaagagaattttgtaagaataaagataaattatggtgggctattactggagctggaggaagtggaaaaagcaggttggcatatgaatttgaaaaggagctaaaaaatcaacagtggcatgtttatagactaggacatagtaattatgatgatttaaggaaaattagtgatagctgctgtagtaatactttgtttattgctgactatgttcaaggacatatagaaaagattgcaaaatggttggaaaagatagttaatgaaaaaagaagttttattatcaaaatattgttgattgagcgagatagtagtaatcagaataataatacgccatggtatgaattattgaatctatatgcaaataattcaggggaacttaaaaatgtttgttatcaggaaagttttttagaattaaaacctttatctgatagtgatctaaaagaaattatgcgtaattatattgaagaatatagtcataatgaaatagatgaagataagttgttgaaagtactagaagatgttgataaagacttaaaaagacctctttatgcattatttattagtgatgcctgtttaaatgatgacaatctgacaaagtggagtcgaaacgaaatattggattatatgtatgatagagaaaacggttattatcataatcgaataaacaatcttttaaataatagtcctaataaaaaaataaatagtatagttgataagataagaacgatagctactatatatgatgatatttctattgaaaactttaaaagtaaatactcagatatatataatgatctaaaccgtttaatagctaatatagatacagtagaatcaacagaagacttcttaaatactattggtcttattgaagatgacttaattaaagcaattaaaccagatttgataggtgaatattttatttgtaaacaaatagaaaatcacgctaatctatccttattatttattgaaaattgggaagcagaaataagtgttttcgaagtcttaattagaatgtgttatgattacggtgatctattaaataaaaacaaagatttcatcaaaaaaatattattatttaattctaataatgaagaatcactatacttgtattcttatttaatgctatttcttacatatcattgtgctaaaaatgatgatatagaagcatattttaataaaataaatgtgttattagaaaatgatatggatgaaaaaatagcagaatcattagcgaactcactatgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactattccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataatccaccgaataacactcactatttaatctaataataaaacaggaaatagaaggaagaaaaaaaatagtaacaaggatagaaaaactaaataaaagatatccaaaaagcaaagaaatagtattgacattagcaaaatcactagttaatctaatactagagcaagaattaaaggagataaaaaaaacagtagcaagaattgaagagctaaataaaagatatcccgaaagtgaagagatagcagtgagattagcaaaatcgctatttaatttaacagtaaaacagggattaatgggaatagaaaagacgataacaagaattgaaaagctaaataaaaaatatccctaaagtgaagaaatagcagtagaattagcaaagtcactatttaatctaacagtaaaacaggaattaataggaataggggaaacagtaacaaaattagaaaaactagctaaaagatattcagaaagtgaagaaatagtaacagaattagcaaaatcactagttaatttaacaacagaacaggaaatagaggagatagaaaaaacaatatcaaaaattgaagagctaaataaaagatatcccaaaagtgaaggaatagcagtagaattagcaaaatcactagttaatttaacaacagaacaggaaataaaggagatagaaaaaacgatattaaaaattgaagagctaaataaaagatatcccgaaagtgaagggatagcagtagaatcagcaaaatcactatttaatctaacattggaacagaaaatagaggagatagaaaaaacaatatcaaaaattgaagaactaaataaaagatatcctgaaagtgaaggaatagcagtagaattagcaaaatcattagttaatctaacaataaagcaggaattaaaggaaatagaaaaaacagtaacaagaattgaagaactaaatataagatatcctgaaagtgaagaaatagcagtaagattagcaaaatcactagttaatttaacagcagaacaggaaatagagggaggagaaaagacagtagcgagaattgaagagttaaataatagatatccagaaaataaaaaaataacactagcattagttaaatcgctaggtaatctaataagaaaagaggtatttaagtaaagagatattaagggaaatgactttgtcaagaaaagtgtgtaaataaattttaaaatatctgttattttattagaactatatatttagaaaatttgcatgttgttgatataagcataaagagacaaggaatcttttgattttcaaagctttgtctttttcttttggttttgtcaaaaaaaggatataaatttacctattataatgaaatagaagtatttattttttcaaataatcattaaattaaaagataaaaattattaagttgtaaataaaaaaagaaatgtaaaaagtgaatgaacagttaaaaactatccattcactacaacctttttaggattataattcttcaatttctttgatccattcttttacattagcatcactaggcattcgccagtcaccacgtggtgatagagaaacagtaccaactttaggaccatcagggatacagctgcgtttaaattgttgactaaagaagcgccagtaaaatttagtaagccattttttgattgtttcatcattgtatttgtctttaaatgcaagtttagtttttctaaatagcttacgtggttcatcaccaaaacgaaccatgtgataaataaagaaatcgtgtaattcataaggaccaacgatatcttctgttttttgtacgatcttgtcattttcttgtggcaatagctcaggagaaactggcgtatctaaaacatcttttaaaattgtttccaatttttgaccgtgatataaactagcaacataatcgactaaataacgaactaaagtttttggtactgaaacattgacagcatacatactcatatgatcgccattatatgtagaccaccccaatgctacttctgataaatcaccagttccgataactaaaccaccaacttgattagctttattcattagaatctcagttcttgttcttgcctggacgttttcatatgtcacatcatgaatattttcatcttgctggatatctttaaattgaactcttacagattcagtgatatcgatatcgtagctagtaacatttaattcttccattaaacctaaagcattatttttagttcttgatgttgttccaaaacatggcatcgtaatagcaataatatttttagtatcatagttcaactttttaaatgccatcgtacaaacaagcaaagccaatgttgaatctaatccaccagatattccaattaccgcttttttaatattggttgcttgtaatctttgcattaaaccgcgcgtttgaatatcaaatacttctttacaacgtttttctcttaacctaaaatcactaggaacaaaaggatgaggatcatagtaataagttgtatctagatcgatattagttgattcaaagtaaatagtttcataagtatttaatgatttaaatgtggtcattttgcgtctttcactagatagtttttttagatcaagatcaccataaatgatttcactatcaaaaccatgactctctttgatcatcgttccattttcactgataatatgatgaccactaaatacgacatcagtcgtactttcaccattaccggcattactatatacatatccacaaatcaaacgagctgattgtgaatttactaataaatgacgataatcttttttactagtaacttcattactagctgaaggatttaaaattaaagttgcaccgtttaaagctaaattaatactaggagcgtttggtaaccacaaatcttcacaaatttcgactccaaatttaaattctggattagttgtagaagcaaaaatatagttttttccaaaaggaattttttgattattaaaaataattgtcgtattttcctctggtgcaggttcaaagcgtctagcttcataaaattcttgataattaggtacatgtgttttaggaactaaccctaataatttaccctgatgaataactgcagctacattatataaactatttagatgttgaaaaggcattccaacaacaacaataatatctttattgattgtttcatcaataatgatcgctaattgttttttagcctcatttaataaccgatcttggttaaatagatcttcacaagtatatcccgtcaaacataattctggaaatactaaaactttagtgttattttcataagcttgattgattaattcacaaatatgtaaactgttattttttacgttagcaatgcttgtatcaaatgaagcagcagcaacacgtatatatccgtctttcattatatctcctccaatgtttatattgtacactttatattatttcttaacaatgaataattgttttttttaagaaaatcgaagataaaaagatagtatttcctgggaaattgtttaaaattgcgatatatttaatttcgtatataagcctataattttaaagcatagctaagaattgatggtttgttgaatttaggggaaatatggtttataattatatatatttggagggcttttctatgagttttgaaatgttatcaaatttagggataaaaaaatatgaaatgtgtcgtgacgaaccaggacgtttttttgcacgttcgatagtagctggtctttatttagggttggcgacggttctatcggttactttaggaacgttattgtttcaaagtaatttaattgcttctaagattgctgtagcggcatcttttggaatcggattagttattatcgttattttggggtctgagttattcacaggaaattgttttacaacgatgataccagtatatggtaaaaagttaaaatttacccagatcattcctatgtggatcatttgttatatcgggaattttattggtattgcactaatttgttttttatttgttaaaagtggcagcaatcatgatttatttgttacttatattgaaagcattgttagtggtaagttaacatttgatgtattagaattatttattaaaggtgttttatgtaattttatcgtctgtgttggggcatatgttggaatgaagatgcaggatgatacagcaaaaacaattattatgatgattgttgtaatggcgtttgtcttaccaggttttgaacatagtattgctaatatgggatattttacattaggaataacaggattaggaacaagttttgactggtcattattacctttacatatgttgattgcaacgttaggtaatattgttggtgggggaatattattaggattcccgctatatatgatgataaaaccaaagaaataaatcttcaggttaactggagattttttagtagtaagataatcaattatcgatgggatataagaatataaagtaaataaaatgataaaatttcttgatttttttttataattgagtaaaatatacttgtaaattaggtattctaaaagaaaaggaagaggtgcgactcttccttttcgctgttttacgggctattattctaattaaatccgtttagacttaattagatataaaattagaaataatattattaggtattccataattggaaactctactatttttaatataagcccgctggaatatgttaaccatacgtttcctccttccattaaaacagcaggcagctacctgcttatattttatcatggtagatatgtttttttgtctcaactttgttccatgtttgtcttacaattatcttattttgaaagtgtttagaaatttcaagaacttagttttaaaatttggattatttttaatcttaaaagataaaaagatggagtttaaaaaagattagaataatgataaacttaagataagaaggggtgatagtatgcctaaaaatatttatgtcctttcagatctgcatggtcactatgacatatttattaaaatgttggaaaaaataaaattttgtcaagatgatgtattgtatattttaggtgattgttgtgaccggggacctgacagtttaaagatatatttatatattcaaaaatttaaaaatattcatttgattaaaggaaatcatgaaattatgatgcgcgatgcgtttaaagttgatgatcctgcttcttcacaaagaagaatgtggtttcaaaatggtggtaataaaacttgtacaagttatcatcaatacttacataaaaaggcttttgatgaatatgattataaagttttaaaagcagctttttataaaatgatgattgaatatatagatagttgtccgtcgtttattgaaattaattgtaatgatcaggattatgttttaattcatgcgggaattaatcctgaaaaaggtttatatgaacaaacagaagaagaatgtgcctggatgcgagaatatttttttatgtccaaagggctggatgataagatcattatttttggtcatacgccaacatgttatatccatcaaaatggtgagtgttttgatgtttggtatgatccggtttttaaagataagattgggatcgatggtggtttggggccgtttgaaaatggacagttaaattgtatgtgcttaaatacgatggaagtttttgtgataaaaaaaggtgagctataatgggaggaagattatgaatttattattgagtagaatattaacatatttaaatgggacattgatatatgatcagcattatcgtttttgtaaatttgttatttataattatttagaattagaagatatgacttttagtgaagtgattgaaaaaagcggtattagcgaagcagatgttttaagcttttgcgatttactaggatttaataattatgaggagtttaaagcgcgtttaattagagatcatatgattcgtttggatcaaattcgggcacggatgttaggtgtaagtagtgaaaaattaattgcgggaatggaaaaatcatgttcgaatgaaactatgaaagagtatatttcaattatttgtgaagcaatttttaaagcaaaaagagttattttgatcggggctttatatccaatgtcgattgcggttgaatttcaaactgatttagttagttttggtaaaccagtaattcaatatcatagttttgatcaaaatattaaatttgatcaagaagatgtaataatttttatctcggctactggacgggcgatgaattcttttatgcaaatccaaaaggaagaagatgttgatttagcgacatcgattcttataactcaaaataagaattatgcttttggaaaacataaaattgcagattatgtaatccaggttccaggtaagtttgatggaattgattttaattatcagatcatgacgatttgtgatctgcttagagtccactattatcaacaatattatttataatgtttaaaaaaggtttttactgatcttagtaaaaaccttttatcgaatcaaataattttcaattgcttctttacagccatcatgatcattatcacttacaataacatcacaaatttctttaatctcatcattggcattttgcattgcaactgctaagcctgctgtttttaaaacatcataatcattattagcatcacctacagcaatagtttcatctaatttaagatctaaataatcacataatttaattaatccacttgctttagtaacatttaaaggcgaaatttctaaagatgttgtttcagctaatgcgaatgtaagcggcagatcttttaataattgataactttttttgcgtgcttcttcgtttagatgataaagattgattttttcaatcattttatctttagaaaggctataaatatcatcgacagttgtagtaactcgttgaaacattggttgatatattcccatatgatatcttgccatttcactaagattctttttagaaacaatggaagaaccattattaaaaagatgaaccattatatcactttgactagctaccgccattattttatcaactatattaaatggtatatattcctggtgaattatttttctattttttaaatcatagactaaagctccactttctaaaactccatattggatatcaaaaatttcattttcataatcttttaattcagctaaacctcttcctgttgataaaacaacatacttatttaaggatgttgctttttttattgccgcgatagttggttttgaaatctttttttgactatttagtaatgtgccatccatatccaaagcaatcaattcataattagacatacattaatttcccctttctgataatttatattataatagataaaaaaaataaaatatatttttttctaaaactgcaaacttaattacagatatgctataataaccacaaaatacggaggaatatcatgaaatcaaaaataagtgcaacaactagtttatatgcttttattgcgagtccagctcatcattctaaatcaccagtgatgcataattgtgcttttaaagaattaaatatcgatagcgtttatttagcgttcgatattaaaagtgaagagctcgaagcagctgttaaaggtttaaaagctttaaaagtaaaaggggcgaatgtctcgatgccacataagcagacgatcattccttatttagataatatttcaacagtatcgagattatgtaatgctgttaatacaattaaattagaagatgataaatattacggtactattactgatggtgttggctttattaaaagcttggaagaacaaaactggtcaattaaaaataacaaaattacaatggttggagctggcggtgctgctactgcgatcatggttcaaatggctatggatggagcaaaagagattgttatctataatcgtagtcaacggcctgaatttatagaaatcatcaataatacgatcgaagaaactaattgtaagattacatttaaatcattaagtgatttaaatgccttaaaacaagatatgcatgatagctatttgtttattaatactaccggagtaggaatggaaccgatgcttgatcgatcagttgtacctgatgaatcatattttgttcccagtttaaaagtagctgatattatttatcagccagcagttacaaaaatgctgcaaatggctaagaataaaggctgtgaaataatgaatggagaattgatgttattgtatcagggtgcggagtcttttaaaatttggacggggcaggatatgccaatcaacaaagttaaagaagttttaggaatcgaggtaaaaggatgaaagagttaatcgttgcttcaacaaatcaaggaaaaatcaaagaaattagagcaatgttgaaagatatcgatattgaagtattagcaatgaatgatgttttagatgatgatattgaaattgaagaaaatggcacaacttttaaagaaaatgccttgatcaaagcgagtacgattgccaagatcgtaaataaaccagtcttagctgatgacagtggtttagaagttgatgctttggataaacagccaggaatatattcagctcgttttttaggtgccgatactagttacgagataaaaaatcaatatattatcgatgctgttaaagataaagattgtaaagctcgttttgtttgtgcaatggctttagtgattcctggtcaagaaccgattttaatcgaagagacaatggaaggaatgatcaatgataaaatagaaggtgaaaatggttttggttatgacccaattttctatttccctccttgtaagatgacttctgcgatgatgtcaatggaagaaaaaaataaacactcacatcgtgcaaaagctttaaaaaagttatatacaattttaaaggagatattataatgaatcatattgttttagtacatcccgcaattcctcaaaatacgggaaatatcatgcgaacttgtgttgctacaaacactagtcttcatatcattaaaccgatgagctttgatttagatgataaaaaaatgaaacgggctgggttggattatgttaaagatctagatctacatgtttatgacagttatgaagagtttgaacaaaataaccctggtgaatatcatttttttacccgttattcaaatatatgtttcactgatcaggactttagtgataacagcaaagagcactacttattttttggtcatgaacatgatggaatccctaaggaaatcttgactaagcatttagaacgttgtttaagaatcccgatgagtgataaagttagaagtttgaatttatcaaattgtgcggctatttgtatatatgaagttttaagacagcaaaattatcccgatctttctaaagtagaggttcaaaagggagaagactttttatatgagttatagtaaaaaagatatttttttatcaatcatgttaatgctttttattattacattagcaatagtctttacagtcttttttaaacagttatattattttgatattgattatttgcatattgatactctcagtggtatgagtgaaaaggtgatcaaagaaaattatgatattttgatcaattaccagtctattttttatcagggggctttaagcttacctgattttacgatgtcagctagtggaaaaattcattttcaagaagttaaagttatctttgaagtgattcaaattacaatgatcatcagtggcttaatagctattttgatgatgattaggcgtttaaaggaaaaagagtatcgcttttttaaattgacagggatgttgacgatcatcattccggcgatgttaggatttgtggtggcactggattttgatcgtgcttttgtcatatttcataaattagtatttagaaatgatttttggatatttgattatcgaagcgatccggtaattaagattttacccgaaacgttttttatgcactgttttatcttgatcgttgtaattgttattatgctggcactattttgtttacttttttataagtataaacaaaagcaaataataaacgatactaatctatagtatcgtggtaatcatggatgagatatttaggctttgtttttaacgaagcctttgttttatctttgataattttaatgataatgctaataaagaaaaataaactaattagtaaaggaatcaaaaaagattcttttttgattgttccataaaacaataaaagggttatcaataatgaaataagaggataatagaatggtaatgatttagttagtaatttagattttttcaaaaaataacataacgtttcatgatcccatagctctacttcattatttttagcgagatttatggctgctttagaaaatgtgttattagtaaaaactacgggaatatcacaattataatatgtacagccgcttatagcttcctggatagccttgattccaacaggtttattataacgtttacattgaattgcataagtataattattttttgtagcaatgacatcaataccataatcattgctgctttttgatattgatacattcttaaaactatttttttctaatagtagtttagtaaaagattcgaattggtagccatcaagattattgatatattcaagatcaaaattattaaaataaatatttttaataatgtgataaataactttaatgatggcttttattattttaaaaggcaggatgatgatattattgatcaaccagacaaatattaatttcattcatacacctccatttggacattataacatgataaatgacaaaattgtaagattatgtaatttacttcgatggtttttcatttattacaggtgtatgctaaaaatacgaggtgatagcaatgaataaaatcaaggaattactagaaataattgaatttagtatcgaattatatttttcaaaataaaaagccttgatagcaaggcttttatcctaaaaagaaagtatttacttcaaaatgagcttgaggatgatcacatgctggacatctttcaggtgcttctaaaccttcataaacaaatccgcagttattacatttccaaactacaggtgtttctcttttaaatgttgtaccattttctaaagctgccaataattttaaatatctttcttcatgatgtttttcagcaattgcgatgctgtctaaaatagctgcaatatcttcaaatccttcttcacgtgctgtcttagcaaagcttggatacatttcagtgtattcttcattttcaccagctgccgcagcttttaaattttcagcagtatttccaagtaatacagggaagctgccatctgtatataaactttcaccagcaaaatctttattcattaatttcattaatcttttggcatgttctttttcctggttagcagtttctaagaaaatattttgaatttgtacgtatccttcttttttagcgattgatgcataataagtgtaacgattgcgtgcttgactttcgccagcaaaagcatgcattaagttgtttgctgtttttgttcctttaagtgtcataatttgttttcctccataagtcttttaatttttagtttttaaacaatttttacaagttccactgaaaacaaggtcgattttttcaatttgatgttcagtttccttttgtacatcattactaatacgttcatcatcataaataatatcaaatacttgttgacattctttacaaataaaatgatggtgcgctgaaagatcagcatcaaagtgtacagtagtttgacccacatccaatttccttattaatttagcttccgctaaaaaattcaaattacgatacactgttcctaaacttaaaccaggattatctttttttaattctgtataaattgtttcggcagtcggatgatcacatctggcttttagattttcatatataagttcccgttgttttgaatatctggtttttgtcatatgcttactcctttttataatagtaatggttactattataatattatattattttaaaacagtcaacactaatgataattattcttaataagactaaatcaataaatatcataaaataaatgtatataaaactaaacagatcataaatgaaagaataccatgatataaacgggcaataaaatattctttaaaactatattcgatgccatacaataaattatctgtttgcatcattacactaatgccactaaaagataaattaaaacatattaaactataaacaagcggtgtatgcttaaattctaataactgtaaactgccagaactaaattcaagaataccttgaataatagcgtttataaaactgtctttaataatatgtgataaagcataaccaataaattgaaaaactaacatgtaacctaaaataaaaataaaagcataacaggagctaagaatactttgctttaaggcttcaacaaagttcaaatggggctgttttaatttagtaagtgattcttgaagagtttggaactgataatgttgatgataaaatagggctttaataatactaggaagtaaatggcaaaaataaataattgcgggattttctaaatttaatgatacaaagataaaagaaattgatgcaaaagaggcaatggagagtagatgctgtaattcattttgattaatgtagtttagttcataagcttctttgatcattttaacatttgtcgggtaaccgcaaaagaaagaaataaagtatattgaagacatgatcggtgataatttaaataatggtttgaatatccattgaattaaataactaaataaatttagtagaccaagtgataagcatagtgatattaaaatcataaaaggtaaaagcgagggaaggagattattaataactattttaatcacattattagaaagagaaacaatttgaaacatattaaaaaaggaaaataaagtaataaatgcgactaaaactaaagtaaaataataatttaactttttcatgtcttcctccatttctattattatttaaatactattgatttttaatcaacaacaaatttcattttcaacattttccttctagtaatattgaataagatagggtaaaattagatgaggtgaaaaaatgggtgccttaattgtaggtgttaaatataaagaaatgaattatgatttggataattcattgattgaattagaagaattatgtaaagcgtgtaatattcaggtagttaaaagatgtattcagaatttagataggatcaatccatcattgtatattggaacaggaaaagtacaagaaatcaaagcacagttagatggtatcgatattgttatttttaatgaagaattatcacctttacaagtaaaaaatttaacagatattttagatgttgaggtaactgatcgtacagatttgatcttgcgaatctttgaagtaagagctaaaagcaaagaatccaagctacaagtagaaatagctaaaggacaatacttattaccacgattagctgggatgaaagaacatctgtatagtcaacaaggtggttcgggttttcgcggtagtggtgaaaagcagttagaattagatcgaagacttatttctaatcaaatagcgcaggctaaaagacaattagcaaaaattgttaaacagcgtcagaatcaacgaaaaagacgtaagaataatgagatgaaagttattgctttagttggatatactaatagtggcaaaagtaccttgatgaatgctttttgtcttaataaaaacaagcaggtattgcaaaaggatatgttatttgcaaccttgcagacagctactcgtaatgtgttaataaataaacacgcctgtttacttacagatacagttggttttatcgatcgtttacctcatcatttgattcaggcttttcgttcaacgcttgaagaagttattgaggctgatttattgatacatgtagttgatacttcaaatcctaattatgaagcttatattgaaacgactaatcaagtattgaatgaattgggagtaaaggataccccgatgatttatgcatataataaagttgatttaaataaatatggttttattgtaccgatagaaccatatgtgtttatttcggctaaggagagaattggattagatcagttagaaacagttatcagcagtatcctttttaaagattatgcaatttatgatttaaatattccttatcaagatggtgaagtatttaagtatttacatcaacatagtttagtgctagaatttcagtatttagaagatagtatttatttaaaaatagagatgcatcctagtcaaatagctaaatatagtaaatacttattaaaaaattgaaggaggttttatcatggacgaaaagaaattatttcgattagatttagcaattgctgttgaggcaaattcagctaaagaagcgtttgatattttagtaactgatgaaacattaaaacaagttcgagaattaataattcaatctaaagacaatattaaagaaatgtttgaaaaggaagaaaaaccggcagtaatcaattagttgattattgcttttgtttttgttaaaatctatagaataaagggggaattagaaatgaatctacacggaagaagttttttaacacttaaagactactcaaaagaagaaataagatatttgctggatcttgctcacaaattaaaagcagacaagaaaaaaggaattttaggtaatcgtctagctggaaaaaatattgttttgttatttgaaaaaacatcaacaagaactagatgtgcttttgaagtagcagcattagatgaaggtggacacgtaacttttttatctaactcacaaatgggaaaaaaagaatcaattgaagatacagctaaagtattaggaagaatgtatgatggaattgaatttagaggttttgaacaaagtactgtagaagcattgcgtgattattctggcgtaccagtatggaatggcttaacagatgttgatcatccaacccaaacattggcagactttttaacgatcgaagaacatttagacaaacctttaaatgaagtgaagtttgtctttacaggtgatatccgtaataatgtttgttatggtttaatgtatggagctgctaaaatgggaatgcattttgtggctttaggaccagatgaattaaaaatggatcctgaagtagttgcttattgcaatgaagaggcagctaaatctggtggaagtttaacaattactagcaatgttgatgaagctgttaaagatgctgatgtcatctatactgatatttgggtatcaatgggggaagccgaagagctttatccaaaacgagtaaagcttttatcaccatataaagtaacacaagagatgatggctaaaacaggtaatccaaaaactttatttatgcattgtttaccttcgttccatgattttgaaacgactgtggcaaaagaaaaatatgaacaaggtattgatattcgcgaagtagaagatgaagtatttagaagtgctaattcagttgtttttgatgaagctgaaaatagaatgcatacaattaaagcagtaatggttgcaactttaggaaaagagtaaacgaagcaatgcttcgtttatttttataaaaagataaatcttaggtaaaaatgataagtttgaaattggaataaatcccgtgaaaaaggattttgagtatgctaatattttgatatgcttatgataaaagactcttattgagctgactagctataaagggataagattttatgtataaaaaagcaaatgggtttatgatcaaaattataattagggaaaatgttaaaagagctaaaaatgtggttatatctgataagataagaaaataatcaaaaattttggctttgtttatgttattatatttgtgggtggtgaaataatgagacgtgtttatgtcataagtgatctacatggttattatgatttgtttattaaattattagaaaaaatctcatttagtgaatttgatttattatatataattggtgatgtatgtgatcgaggaccagatagtttaaagatcttattttatattcaagaacatgataatataattttaattaaaggaaatcatgaatatatgatgcaagaggcattgtattatggggtttattatgatgatattgattatccttcaaaagcctttaaattgtggattgctaatggcggaaatacaacgatggagaatattcgcgagtatcttcaaaaagataaattaaaacatgaggattatcgggtggttagaagtgcatttttaaagaatttatatgaatatttaaacaatttaccagaatatttagaaatagaagttaataatcaaagttatgttttagtccatgcaggaatcgacgttaagcgtcctttagataagcaggatctagatactttgctttggatcagggaaggattttatttacaacgtggtgatttgactaaaatttatatttttggacatacaccaacggcattattaaataaggattatagttttaatatctggcttgatgaagttcatcataataagattggaattgatggtggtttagcttgtggaacagttggacaattaaattgtttatgtttgaatgatggtcaaattacagtgattcataagggaggataagtgatgcgaagtgctttttataatttagttaattttattaatacagctaatattaatgacgtttatgcaaatgccgcaaggatgattttacggaatatttatttgattcctcaaagtacgataactgatgttgctgatttttgttttgtttcaacagcgacgatttctagattatgtcgaaaacttaactatgaatcttttgctgattttaaattggatattacaatgaatcttaattattttaatcgtgatgctctaagactacagtttgatcatcaattaccgcagcggaaatatttacataaaggtaaagaagtatttaaagcacactttgaaaatatcattgataatttacgagcaacttacgataatatcgattatgaagatctagagtttattgttgataatatccatagtgctaataaaatttgtttcgcaggcaatttttttacgcagtctgtttccatgcagctacagatcgaactttcttatttaggaaaagaatgtagcgggatgtatcctttatcgcagcagcttttagtaattgaacagttaacgaaaaatgatgtgattattgtatcgagtattgctggtggttttatgatcgatcatcctgatgtgatgcgtgcgatttctaaatctccagcttataaaattgtaataacgcaattagatgagtttgtatatagtaattcagtagatatgattttacaagtaggaacagatcaccagtctttgattggtaagttttctattacgtatatttttgaggtattggaagcactgtatcatcttaaatatgggactaaggatcttaagtagaatatagataaattaaatgatgaaactattatgtgaattagttatcatcattttttattattaaattaaaaaagacaaaaaatatatttaaaaaactaaatacgtttttatataaataagatacgataaatttatgaaaccgtttacatcacatgatcaagtaatatactatttttattgtgtttaagtaaaacggttttgttaataaatagaatttaaaacgaggaggcgataaataaaataataagacgaattttaattaaaaagataagtgtgaaaaataattgaacccaatcgtgagtaaaaacacaaaaaaagacgaacttaaaaacaagttcagttttatttagaaaaaacagaatattatttaggaatatcttgaattgttgatacatcaaatccctgtgattttagaaaatcaagtgctgtctcaactgtataattgttcttttctttttgtggctttggattcttaaatgattcatagtctgaaggattgaacttttctccagtaagaatcatatgataaatactgacaagcatcatccttgcaatagctatgattgctttcttgtgtcctcttcttttcttgatttttgtatatttttgaccaaaataactgtttttgtttttgatagctgccaatgcacattgtactaatactggtttaagatattgtccagctttgttgatacgaactgatttcttctttcctgcactttcattattggcaggagaaagtccagcccagcagcatagttgcttatctgtttcaaattgagtcatatcaacgccaatttcagaaatgataagaatggcagacataagctgtattccatctatttctgtaatatgtaaaaaatcatcaaagtatctggaagcacgtttgatgatttctacttcaacagcttcaatatgttgattaagttcattcatatgtgattgaatttctgccattttaaatctttgatctggctcaatttttgaacttttaagagattcaactattttatctttgtttttgcacttaccatgaataagttttgtgattttatcttcatcaataacttcagtagatagaacttcattcatgacggcctgggctgtttttccaaaagtatcagaaacaacagaagccaaaccaatattggaaacagtcatggagttctgataacggttacgttcactagttctcatacagatgagcttaaaacgataacgagagagatcccttaattcacgaatatccttaggcgggataaaagaagatttgagaagatcatgcttgaaaagatcacaaatccatttggaatctttcttgtctgttttcttgcccttgatagctttgacatatttaggatggacaagaacaatattcattttagcttcagtctcaaggacattaaagacagggaaccaatacttaccagtggattccatgcagacatcaaaacattcgtgttcaataagccagtttttaagattatagaggtcaaagttaagagaagagaaatctttctgaatatattcagtgacatgagttttcttgtcagtgataccaatggtagcgacgataaggttcttgtgaacatcaagaccagcacaattaaaacggtggattttaagcataaaaaaactcctttcaaaaaaggagaagtggcattgactgtcagtctgcaaaatatcactatagttgataaaaacaatcttaagtgtccaggctctaagtcctacttgtttgtgcttgaaagactgacggcgacttataattattcaggatattctatatagagtagaattgcctactctcctccacgtgctctgtagtataccacctctcttataggatactacaaaaacgattggatgagaattatttttaataaaatgtttgtgtctgaccgacgaaggcggacggaaatggagggaattatgggaaaagaatattaaatgaaaggataaaaatgatgaagttaagtaaaatagcgttatcactaacgatgatcatgactctggtaccgggaataaaccatataaatgcagctgaaagttatattagtgatagtgatttatcaactatgcaggtggcagctccagaaccttggggagttactccgacaaatgagcagtatcgttatcaaaaagaagagttagcaggttttgttcactttggacctaatactttcaatgaaattgaatggggagaaaattatgggaataaaaccccagacgaaatatttaaattagaaaatgattttgatgccgagacattggtaaaagcatttaaagatgctggatttaagaagatcattgtaactgctaaacatcatgacggtttttgtatttggaatagtcaatatacagattatgatgttgcaaatacaagctataaaaatggtaacggtgatatcttggcagaaatttcagcagtttgtacaaaatatgatattgatatgggattgtatttatcaccatgggatattcatgattctagttatggttattatgatgaaaatggtaatgcgacaactgaagaaaatgatgtgttagattataatgactattatgtaaatcagttaaatgaaattttaggaaatgataaatatggtaataatggtcattttacagaaatttggatggatggcgctaaaggaagtggtgccaatgcccaaaaatatgattttaaacgttggtatgagacgattcaaacacaagaagggttagaagctggctttgatagtgaatgtatgatttttcaatgtggagctaatacgacagttcgctggattggaaatgaaaatggttttgcttcaaaaaatacctggtcaaaatcaaatgttgatatcgaagctgatacatgtgatgataatgtccagggaagttattcattgggatatgaaaatggcaataaatggacagtacctgaagctgatgcgcggattacatcaggatggttttgggggacaagaaagaatacccctaaaagtcttactgatttaggagatatgtattttaattcggttggtcataatgccccattattattaaatgtaccacctaactcagatggaacagttgatcaggcaatattagatagattagctgaatttgggagaaatattaaagaaacatttaataataatttagcagcttcaacaaatgcctcaataaaagcttcaagtgtgcgtggtgacgacattacctatggtccaggaaatgtcattgatgtaaatgatgaaacatattggacggttgatgatgggatacaagaaggtactctgttaatagatttaggttcaacaaaatcatttgatgttgtttctatcgaagaagccattcagtttggtcaaagtatcaatgaatataaagttgaatatcgtaatggcgaaaatagcgaatggaaagtcatggatgaaggggaaacgattggggccaaaagattagtccggacagcaactgtaagagctgatcagattcgaattacagtcgatacaaacaaaagcgatgcggtgccgatcatcagtgaagtaggtatatataaagctagcgaaggatttgagctagcgggtatggctcctgaaggaatggatgttattgatattgaggatactgatatttcagatggaatgggttatacatttaatggtacatggtataaagaaaatattacaacttgtattaatgggacaaaccgttatgctaatgcgggggcatccttaacccttacatttacaggcagcaaagtttatctgatgggtacaaaggatccaaatcatggtactgctactattacaatagatggtggtgaagcagaaaaaatagatacaaatgctagttcacgggcaactggacaaataatttatgcttcaaaagatttagaagatggcgaacatactttaacattaagtgtagattcaaaagcgattggaatcgaagctgcatatgttattaacaatggtggcaaaggtatgattggattagaagaatctagttatacaatgaatgaaaatgagagaatcaatgttaaaatagttcgggttggtggcaacaaagggacaataactgcaaaattacaacctaatccaggaagtgcgattcaagatgattttaatactgaactgattactaatatcgtaatggaagatggtgttaatgaaacttatgctcctgtagaaacaagaagaaatactaatgcaacaggtgatcgagtatttagtgtcgaattaacagaaccaagtagtggtttgattttaggatttaatgataaagcaaatattactattaaagatactgaaacgagttctttagaaacattgaatatgcttcttgaatcaggaaaacaaaagattgaagactggtatatatcaggttgggtacagtttaaagctgcattgatatatgcacaagaaattgctgaaaaatcagatgctgctatttctgaaattgaaaaagcaattgaggatctaagaattgctgaaaatggattagttaaaagagaaaaatatactcaagaagatccttttgttttcccttggcaaaaagagacatcagcagtacttgaagctgaatttgcaagcgaaatcatcaatgatccaagcaatgataatggctggccttgtgtcgttactgaaggttcatgggcaagtaatggaaaatttattgatgctatcaatcatggtgatgtcgttaaatataattataatgcgataaaagctggaatatatcatgtaaaagcatattatcgaagtggatcaacgacaaatgctttagcgtggtcagaagaaagcggaaaaatagaaagtggcagtgtgtcagctggagctagcagtacagcagcaacgcatattgcagaatttgacttaaatgtaaaagaagctggtaatggggtattagtatttacaggaccagcgggcagatcaccacagcttgataaattagtttttacgcctggtgatattgaattgagtacatataatattgaagcaattgccagtgctggtggtacaattagtgacgaaggtataactgaggttactgaaggtgatagtaaaacatataatattattgctgatgaaggatatgaaatcaaagatgttcttgtagatggaaaatctgtcggtatagttgattcttatacttttgaaaatgttggtgcaaacgctaaaattgaagtaatatttgtatttagtaaatatacagagaataacccatttgttttccctgaaggaaacgatacggtagttcttgaagctgaatatgcaaatgagatcatcaacgatccaagcaatgataatggttggccttgtgtcgttacggaaggttcatgggcaagtaatggaaaatttattgatgctatcaatcaaggtgatgtcgttaaatatcattacaatgcaataaaagctggaatatatcatgtaaaagcatattatcgaagtggatcaacaacaaatgctttagcatggtcagaagaaagcggaaaaatagaaagtggcagtgtgtcagctggagcaagcagtacagcagcaacgcatattgcagaatttgacttaaatgtaaaagaagctggtaagggagtattagtgtttacaggaccagcgggcagatcaccacagcttgataaatttgaaatcatatatgtcgaaagtttagataaagcaggattgaatgaggcaatcattgttgctgaaaatttaaacgaagctgattatacgacagaaagctggactgtaatgcaaaatgctttaacagatgcaaaaattgttgtagctaaagaagatgtgactcaagaagaaattgatatcgcagcagcaaatttaaatgcagctatagaagctttagttgaaaaagtaattgaaacagataaattagctttacaaattgctattgaaatggctgaagatgtaaatttagaatatgtcttaccagttgtagtaacagaatttaatgcagctttagcaaacgcaaaagaagtatatgataatactaaagctacacaagttgaagtaaataacgctttcgatcgactagcgaatgctatgcatatgttagaattctttaaaggtgataaaacagcattacaaaaacaagtagatatgatcaatggtttagaagcagataaatacattgaatctagatggaatgcaatgttatcagcgttagataaagcaaatgatgtactaggtaacgagaatgcaatgcaggaagaaatagatgaagcgtatatagaattggtaaaagctttcttagacttaagattaaaaccaaataaggatttactaagtgctttgatcaataaagtaaatggattaaatgaggcaaattatacagtagcatcatgggaagtaatgaatgaagcattaaatgatgcaatagtagtattagaagatccagatgcgacacaaatagaagtagatgcagcatatgaggcattgataagagcatacttaaacttaagattgattccaaataaggatctattacaagggttgatcaataaagcaaacagcttaaatgcagcaagttatagtgctgaatcatggaatgtattacaagaaacattaaacaatgtacaggcagtgttaaataattctgaagcaagtcaagagcaggttgataatgctaaagatactttaactaaggcaatggccggattagaagtaattgaagctggtaatccagtcaaagctggagattcaacagtaagtattaaaacaggtgatgatactttaactggagtatttgcgggattaggattaataagtatggttacggttttagtaagcaaacgaaaagaagattaatgaagtgaagtcaacttaagatagtatcttaggttgacttttattatgggatgaaatatattatgtcataataaatcgaaatttatcggaggataaaataatggaagatagaaaaatattgttagataatattgataaaattcatacgacggaaatgggaattgagagaattaaaaggaatttaaaaatagatcaaactgatgtagttgaatattgtaaaaataaagttttgaaagaaacttgtaatatttatagacaaggtaaaaactggtactgtgaagttgataatcttaaaataacgattaattcatctagttatacgattattacagcgcacataataaataattagttgaattgtagtattttatgaaaagaataaaaaacacagcagattttaaatgctgtgttgttgaaattttattatataagagagtatgaccacatcgcttttatttgtgatgcaagtctttcatatgtccatgaacgttgactgttttccttattgttggggtcattgagatagaattcaccatcaatagttttagttattactagaaaatgcccggttgttgtaaaatcacctggtttaacactacagataatgggatttccttgatttagttgattgatcatagaatttttgtctaagggaacggctgaggcttttaaattaaaagcttgacatcctttttccataaaagtccaggttgttttactgccttctaaataaccattttcactagcatatttagcaacaaaacgaggattgtaatcagtattgccagtaagaccgacagctaccatcgcgatacaggtaggaccacagccagcagttccgatgatttcatcaccatagggagtatatgcccagcgcttatcccactggataaataaggggatcttatcattgatttctaaagtgatcggatcgtcgttttcttcgctttgataatttgtttttaattctattgcctgagggttatttttgacaaattcttcgatatattgagggcaatcattgttattatcatataagaaatgaggaactatctgaatacctagatagccaattgctagaacaagaataaagcaaataaatgcaggtgctttttttaatttcataatgtcattgaatagtatttaatagcaattgaaaagatggcaattgctccaagaatgataacgatgattgctttttctttgatagataatttttccataattttagctcctttttatagtataaatgatggtaatagaacaggatagaactcatgaagtgaaagataaccaatcatgccaaaactaacgagaaatattgctgaaggtaatttactacgttttttgtgagtaattaaatggtatatgactaaaccgataataccacctaaagtgtttagaaaaatatcatcaacatcaaaaactccccatcctgttgctaattgaattaattcaaatgatagactagttataaagtttgtaaaaataacattactgtaagtaagggatttaaaataatttaataaaataatacttagaggaataaataatgcaatatttcctaaaatattaatcaataaagtttggcttaatccatgatcataatactggttaataaaatcaaataatataaaatttattttataaccttgattagtaaaaccatttttaagtaaaatgatcttaattaacatccaaaaataaatcagagaacaaaaccccaggacaaaattggatagatgtggtttttttaatgccataaatattacctccaatctaaaaacctattctatattgttatcataacaagataaaataggttatgtattgacatttactaaagaaattcttacaaatttcttacaatggtaatttaactgtaaagataattaatttattatttaaatcagcacgaattgtcccatgatggagttcgatgatctttttagttatcgctagccctaatccggaaccaccggtcttactacttcgtgattcgtctaaacggacaaagggttcaaaaatatgatttaacttattcttatcaacaaaattaacagaatttgataattttatgataatatgatcattttcttttttagcactaatattaatttttgaatctttatcactataattgatggcgttacgaataagattatcaaaaacacgttcaaattggtttatatcgatcgatacaattaaattatcttcgatctcattaacacattcaagatttttttctcgatataaaggcatgaattcatatgatatttgcgctagcatgattgataaatttacttgctgtttatctaacgtgatatcgcttaaattatatttagcgatcaaaaagaattcttcgatcagttcttctaaacgaagcgatttatcataagcaatttttgtataattgcttttttcttctaaagataaattagtttggctttttaataaatctaaatagccgataattgatgttaaaggtgtttttaaatcgtgagctaaatacaacaataaatcatttctttgcttttcagcctgtttaatagcagctctgttttttaatgaatcttttttgatttgattcatttgatcctctatttctttaagctcaaagggaagactgattaatcgctcgctatcttctacaagtatttttcccgcttctaacatcttttcgatatactgtaaggattctcggtatcgaagccaaaaaataatgatagtatcaagagcaataagactgatcgatatagctggtaagttatctttgatcaattgagccaactgataaaccaggtcatattcttgccaaacatattgatgatagacttcataagaataaacaaataggataataaaagtaatgatcgatatcccaattgtaacagctattttttttaaaagattagccgttaaactttttttgaaatgagaattattcaattgtataacccactccccaaacagttttgataaatttaggtttacgagcattttcgtgcattttttctcgcaatctagctacatgggccatgacggtattattgttgtcgagatatttttcctgccaaacagcttcaaataattcttctgatgttaccacactgccttttttactacataaataccataaaattgagaattctaaaggagtaagatttaaaggctgatcgtataaagtacatttatgattgtcattattgatcattagaccattgaaatcgtatatttgctggttgggtgtcgtttcactagtattataacgaagatagcgtcttaattgggttttgacacgcgcagctaactctaaaggattaaagggtttagttatatagtcatcagctcctaatgttaaaccattgatcttatcaagatcattattttttgctgtcaacatgatcacggggaaaaaataatctttacgaatttcttttaataaactaaaaccatcaagatctggcatcatcacatctaaaatggcaagatcatagtgatttttttgtaaactgtccaaagcatcctgcccgtgatagtatttaaaaacatgataattttcgttttgtaaatataattcaactaaatcagcaattgattgttcatcatcaactactaagatattgtaagccataatatcacctcacttttcatcttagcctattttgtttaaaaagacaaatttatcgtgtttttttaagaaaattgtaagaaaaaagggttaaattattttaaccccatgctattatttaaatatttatcatttaaagcgattacttctttcattgctttaataccaggagcaccaattgtattacgcttatttacacatgtttcaacactgattgcttcataaatatcttcatcaaaaacatcacaaatagctttaaattcagcaatacttaaatcatctaaatctttattttgatcaattgcataaagaactagacgtccgatgattccatgagcatctctaaacggtacacctttattgacaagataatcagcagcgtcagtagcattagtaaaaccaccagttgctgatttacgcatttttgttttattaaaagttgttgatttcaacatatcatttaataattgtaaacagcctttagtagtcgttaaagcatcaaaaacaagttctttatcttcttgcatatctttattataagctaatggaatacctttcatggttgtaagcagactagttaaagcaccataaactctacctgtcttacctctaattaattccgcaatatcaggatttttcttttgtggcatgattgatgacccagttgaaaaagtatcatctaattccacaaattggtattcattagtattccaaataataatttcttcgctgattcttgacatatgcatcatcatggtagccatagcacttaataattcaattaaataatcacgatcactaacaccatcgatactgtttaaacaaggaccatcaaaccctaataattcagcagtgtaattacgatctaacggataagttgttcctgctaaagctccagaacctaatgggcatatattcattcgatcatagatatcttcaagacggctgctatcgcgtttaaacatttcaaaataggcaccaagatgatgagctaaagtaattggttgtgctttttgtaaatgtgtaaagcctggcatgatcgtatctaaatgttctttcataagatcattgatcgttgttaaaagattgtgaaccaatgtatttaacattacaacctgatcacgagtatacaaacgcatgtctaaagcaacctggtcatttctacttctaccagtatgtaattttttacctgtatcgccaattcggtcgatcaaggtagattcgacaaagctatggatatcttcttgtgaattatcgatttcaagttttccactttcgatatctgctaagatctgctttaaagcagtttcgatctggttaccttcttctttagttaagatgccttgtttagctaacatttttacatgagcaatacttccttgaatatcttgttgataaaaagtttgatcaaattcaatcgatgcattaaaatcatagactaattgattagttggtttggtaaatctgccaccccataaattcattttcttacctcctgtataataaaagggctaaagcccttttttattttttattatttaatttcattgctctaactttagttgaaagaccatataaagtaatgaatccttcagcatcatgatgatcatataaatcacctgttgcaaagctggcaatatcttcatcatataaagaatatggagaagttgtaccttctttgataatgtttcccttatataatctaaacttagtagtaccgctaacaacttcttgagttttatcaacaaaagcagttaaagcttcacgtaatggtgagaaccatttagcagcatatactaattcagcaaattccacagaaactaaacgtttatattttaaagtttcacgatctaatactaattcttctaactgacgatgagcttccattaaaatagtaccacctggtgtttcatacaccccacgtgatttcattcctacaacacggttttcaacgatatcaacgattccgataccatgtctaccaccaagttcattcaattcttcaagaatagcagttaaaggcatttcttttccatttaacttaacaggaacacctttttcccattctatttgaacatgttcagctttatcaggtgctttttctggtgctgttgataaaactaataaatgatcataatttggtgtgttttcaggattttcaagttctagtccttcatgtgaaatatgccaaatattacgatcacgtgaataactagaatctgcagagaatggtaaattaattccatgagctttacaatattcaatttcagattctcttgaatccatcgtccatttaggatcacgccaagcagcaatgatctttaaatcaggagctaatgctttgattcctagttcaaaacgaatttgatcattacctttaccagttgctccatgacatattgcagtcgcaccttcttgacgtgctacatcaactaatactttagcaatcaatggtcttgcagtagcagtacctaataaatatttatattcaaatacagcatcagcctggacagttggaataatataatctttaacatattcatcaacgacattttttatgtaaagtttagttgcaccacatgcttttgcacgttcttctaagccatctaactcatcagcttgtccaacatcgatacagcagcaaataacttcataatcataattttcttttaaccaaggaataatagcagtagtatcaagtcccccggaataagcaagaacaactttttctttcatcatttaatcccccttataataactattaaattatcattatcataaactatagaaaaaataattgcaatattttatcgcaattatgcgataattttattggatgttcatatttgagcaacagtaataaaatgaagtataaaatataaataggggatctttgtgagtgaaaataagctggattatcaaaaaaatttaaaatagtcttaattgccatagcttgttattggaatttgataataaataaatcgattcaaaaagatttataaaaaagggcagtgaatctaaaaataaatattatatcgacgaagagatgatcagagaggaaaaatatgatgtttttttataataactactaatctggaggcagttaaagattataaagaatcgatcggtataagatagaagacggttttagagtcttgaaaacacatttggaagtcatacttaatacgaaaggaaggtatttcacaacagaagaaataaaaaacatgaatgttgtaaacaatcatgacttgtactttcaagcaacatatgcaacagtaaaatttgtgaagcattgaatgaagaattcagattggatttagataaggaatactatcagccaaaagttcttaataaaagattttgaaataagatttccatacaacataaaaaatgcgaaattccttatttatcaaggaattccacattttttatgctctaattgtcaaattcaggattaaataggctatataaattcaattaaattatctcataagatatttaaattttaatatgttatttttttaagatcctaatacctatatatgttataaatattataaatattatttgtactacacctagaatataatttgtaaaaacaaaatcgtataatgctaaactgataccaagtaaatcactaaataagatccaagttattgctctgttttttttacttgcatctaaattagcatcaatacagatatctttaatggctgttactacaataaaaaacataaaatgcattgcttctagtaataatcctttaaataacaaaaatataaaagaaatcccgaataataataacgtaaaaatatcaatctttctataaatattcataaatatgctcccttaaaattgttggtagtgtcaaaaaacagttagttttttatatgtctttttaactgtaaaacctcattctaccttggttttttatatattctgattaatttcccccgaaattaatctataaacttaaccatttcctctatacaaaaatggtaactacatcctataatgaagtcaccacaacaatcacaaaggagtgtaattaccatggttaagattatatcatttattatttctttattaaatatctttcgtaaacttttatataaatttgaatgctttcttcttcagttccttcctaacgatcctaatcctaatccggttagtgatgcctacagaagattcaaggttcatcctttacctgttatcgaacctgaacatcttcctgtctctttcgatgaagccagggctgcttatgaagctaaacacaacaaacctttaaagccggtttttagacataaaggtactgtctgccctcattgcggtgccactcatgaatacctttcttttaataatggtcaaaagaaatctcaaattaaatgtaaagtatgcgaaaagaccttctctactgaaaaatcctattctcagcaggttgttagaaaatgtcctttctgtggtaaaaaactgactcttatcaaatccagaagcagttttgacatttataaatgcatgagtcccaaatgttcacactatagagctgaactgaaaaagctttccaaagaggacaggaagaattacaaacagactccttctgctttctctcttcattacatcactcgtgttttcaatgcttctttagacagactggaaagcattcagcttaaaattgagccctcaaagatcgatttgacacgcatacgcaattctaagcatgttttagggcttgccctgacttattatgtcaattacggcctttcattgagaaaaactgctcttattctccatgaagtccatgatatcaagatatctcatcagacaattgccaattatgcccaggctgcaagtcatcttctttttccctggatggatagctttaagcatgacctcaatccttatcaatgtggtgatgaaacttatgtgaaagttttaggcaaaaaagcctatgttttcttcatgtgtgatgtcagaaagaaaatcatcacttcatataggatatacatgaaacgtgatactttcagtgcaatcgatgctttctattctgttttaagaaaattcaaggaaatccctgaaaatctcgaattcgttgtagatggcaatcctatatataaagcagctcagcaatattttcagctcaaacgtgttttctttaaagttacacaggttattggtcttacgaatgatgatccagtatcaaaggaacatcgtcctgccaaacagatcatagaacgtttaaatcgaacatttcaatattcatatgccgtcaagaacggtttcaacacgtttgcaggtgccaatgacttcatgtgtctgtttacaacatactttaactttttaaggaaccatacagctctaggatataaaccgcctgtacagcttgactgtttaaaaaagacacataatatgccaagtaagtggaacatattgcttgatgaagccttgaattattacatagaatcgactatggaattctagttatgaaaaaatttcattttttcataacttatttgacactaccaaattgtttttatccagggaatgttgtttcataggttcctttttctgtatctaccaattgtctttttccgttcactttagcttctgtttttatcgtatagtagactttataatagcctaaaaaataccctgttgaatcatacatttcgtaaaattttctttcagtagttatccatgcttcaacagaagatgcatttaaaccgaataacactgatgctattcctgttgctacactaccaggaagacctgcaaaacctaatactgcactaactgcacctaaaatagctgagtaagatgcatttttaggagtaacatgatctgtagacttaaatgttgtaagatatttttccaccaaacctgctcttgttttttgatttatcgctttattacccaaattatctttaagtaaattataatttgatgataaattaaattttgtaatttctcctttttcttttattactaataaagcagtattattaggataagtgtattttttgatttctactttttcatgattaatattaattacatcatgttcaaaaatataatcttcaaaaattttaaattcagaagtatcgtgctcaatagtattattcattccacctattggtacaaaagaagtaaatgttattaatgctacacataaaatactagtaataaggcatttatagtaattttttttcataattccctccatttccgtccgccttcgtcggtcagacacaaacattttattaaaaataattctcatccaatcgtttttgtagtatcctataagagaggtggtatactacagagcacgtggaggagagtaggcaattctactctatatagaatatcctgaataattataagtcgccgtcagtctttcaagcacaaacaagtaggacttagagcctggacacttaagattgtttttatcaactatagtgatattttgcagactgacagtcaatgccacttctccttttttgaaaggagtttttttatgcttaaaatccaccgttttaattgtgctggtcttgatgttcacaagaaccttatcgtcgctaccattggtatcactgacaagaaaactcatgtcactgaatatattcagaaagatttctcttctcttaactttgacctctataatcttaaaaactggcttattgaacacgaatgttttgatgtctgcatggaatccactggtaagtattggttccctgtctttaatgtccttgagactgaagctaaaatgaatattgttcttgtccatcctaaatatgtcaaagctatcaagggcaagaaaacagacaagaaagattccaaatggatttgtgatcttttcaagcatgatcttctcaaatcttcttttatcccgcctaaggatattcgtgaattaagggatctctctcgttatcgttttaagctcatctgtatgagaactagtgaacgtaaccgttatcagaactccatgactgtttccaatattggtttggcttctgttgtttctgatacttttggaaaaacagcccaggccgtcatgaatgaagttctatctactgaagttattgatgaagataaaatcacaaaacttattcatggtaagtgcaaaaacaaagataaaatagttgaatctcttaaaagttcaaaaattgagccagatcaaagatttaaaatggcagaaattcaatcacatatgaatgaacttaatcaacatattgaagctgttgaagtagaaatcatcaaacgtgcttccagatactttgatgattttttacatattacagaaatagatggaatacagcttatgtctgccattcttatcatttctgaaattggcgttgatatgactcaatttgaaacagataagcaactatgctgctgggctggactttctcctgccaataatgaaagtgcaggaaagaagaaatcagttcgtatcaacaaagctggacaatatcttaaaccagtattagtacaatgtgcattggcagctatcaaaaacaaaaacagttattttggtcaaaaatatacaaaaatcaagaaaagaagaggacacaagaaagcaatcatagctattgcaaggatgatgcttgtcagtatttatcatatgattcttactggagaaaagttcaatccttcagactatgaatcatttaagaatccaaagccacaaaaagaaaagaacaattatacagttgagacagcacttgattttctaaaatcacagggatttgatgtatcaacaattcaagatattcctaaataatattctgttttttctaaataaaactgaacttgtttttaagttcgtctttttttgtgtttttactcacgattgggttcaattatttttcacactttttctccttagtatttatttttttaccataaatatcttattatcaataattatcaaatttatatcaccttatattttttgttaattaaattatatcacgataatcacatctttttgcttacaatttgtccttgaaaaataacgatttatcctatgtttactaaaattattgtattaaaacacttcgtgttagttcaaagaagcttctgcatggcttttactcatctgtttttagcaccatttcataaaattccaaaaaatctttagttgctatactatttgtacttagtggactaaatgtattatcaattttatcttcatctccagattctgtttcgaatttttcctctataaattctgtttgtttaagatgcataaatacgaaattaataatattattttttggtgagtaatccctgcaaaattgatgaaacttattatatgtgcgtctagatatgctttttgatgacttgccctttttggaacaatcttggtaatattttttataatcaatcaaatatactgctttgaatagtcttccctgataaatagccatttcgaataagatgtcccaaaaattttactttattattagtcgtaagcttttttacagttctcttattcttacatagttaacaataaattcaatatcactaactattttagatgtaatagaatgtgaatttttaaagattatatctactagttcttgttcttttttgttgaaatatttattcattgaagagtttaataagtttaataactcttcaacaaccaaaatcgcttttatcgatgctaaaaaaactaaacataccacaagattttccttgataccttttacatcattaatatttttcaaagatttttatgagagtctacatttatcaaggacttttgcatttttttatgctttaattgttgaatttgggattaaattatcattactataaattctagaaaaatagttgcaatattttatcacaattatgcgataattttattggatgttcatatttgagcaatagtaataaaataaagtataaagtataaatagggggatctttatgagtgaaaataagctggattatcaaaaaatcttaaaaatagtcttaattgcgataatttgttattggggacttaataattatgaaataatttttgcaacctttaataacttattatcagtaatcatgccttttattattggctttatcattgcttttattttaaatgttttaatgatcagagttgaaaaattactaaaaatgttttttaagggaaaatggtttgatcgttgtaaaagaattataagcattattttatcgatgttaatattgattggggttttaacattaataataaatcttgttattcctgaaatatctagtgcgataaagctgattgtcaaaagtttaccagaagtatttgaagatctgcagcaatggagtaaaagcaatggtggaatctcaccacggttagaagaattattaaataacattgatttgaacgcaattacaaaagaatttagtaatgctttaaaagtgggatttacaggattcttagggtcaacagttgatattctttcaatcctaatgagcagcattgttaatgtggttgtgggatttgtgtttgccttttatattttaatgagcaaagagacattaaaacgacaatctcataaattaataaagacgtatctacctgcaaaaatttctgcaaaattagttaagattgcgagattatcacgaacaacttttacgaattttattattggtcagacgatcgaagcaatcatcttaggctctttatgtgcaattggaatgaagatactaggattcccgtatgctccaatggtaggaactttagttgggataactgcttttgtaccaattgtcggtgcttttattggcggtggtattggtgcgtttatgatcatgacggtcgatccgatgcaggcagtgttttttatcatttatctagttgttttacagcagcttgagggtgatttgatttatccaagagttgtgggatcatcagttggtcttccatcgatttgggttttgtttgccgttactgttggtggtggtttatggggaattgttggcgttttatttagtgttccagtcttatcggtaatctatgctttaataaaggaacatgtaaattcagtttaaaagatttgttttatcctgtaattattttacaggatattttttggatttaaataattataaaatatcttgcaattatatggatatagagctactataataatataaataataaaaataatttatttatgaaacgaggagatcaaaatgttaagaattgaaaatctaacgaaaacttttggaagtaaaaaggcagtagatgatttatcactgcatatagaaaggggacagatttacggttttattggtcataatggggctggaaaaacaacaactttaaaatctattgtaggtattatggaatttgaccagggagatatttatattgatggtaaatcaattaagaaagatcctcttgcttgcaaagcgattatggcgtatattcctgataatcctgatttatatgaatatttgaccggtattaagtatttaaattttattagtgatgtttatggtattagtcaagaagatcgtaagatgaaaataaaaaaatatggggatatgtttgagttgagtgactctttgggagaaccgatcagtgcatactcacatggaatgaaacaaaaattagcgattatttcagctttgatccatgatcctaaattaattattatggatgagccttttgtcggtttggatcctaaagcatcacatttattaaaaggtttaatgaaagaaatatgtgatcaaggtggggcgattttcttttctactcatgttttggaagttgctgaaaagctttgtaataaaattgcgattattaaagcaggtaaacttgtcatatctggaaatactcaagaagtcattggaaatgaatctttagaagatgtatttttagaattggaggatgaaaatgcttaaatcattaattaagattcgattacagggaatctttatgcgttcaatgaaaggtagtaaaaaacaaaaaattactgctggtaaaatagttttgatgttatttatcctggcttatatagcacttatatttggaacgatgtttggttatatgtttgatcagattttaaaaccttttacaatgatcggctttgaatggctatattttggaatcatggcagttttggttgttttattgtgtttcattggcagtgtgtttacgacacaacaagaaatatatggggctaaggataatgaactgctcttagcgatgccgatcaaaacaaaagatattttacttagtcggatctttgtagttttgattattaattatgtttatgaagctttagtggctttaccatgttttattgtttattttggtcaaacaccttttgatattattaaattattgttttttatcatcgttattattactttacccttattggcattgactttatcatgtatctttggctggctgatggcaatgatcatgaaaaaaattagaaataaaacgattattacaatgatcatttccttaggttttttaggattatatttctatgtaatcaataaattaccagattatttaatctcattgattgctaatgggaaaactatcggtgaagcaattagaaatactttatttccaatttatcatttgtcaattgcaatcagtaaaacaaatgcagttagtctaatattatatttactttgtgtcttattaccatttgcattagtgatttatttactttcaaagaattttattagtattgcaacaagtaaaccgatatctaaaaaagttaaactaaaagattctgatattaaaacatctaatcaaaaaatggcattatttaagcgggaattaaaacattttacctctaatccaatggtaatgttgaatgctgctttaggaattgcttttacggttgtattggccggagcactgcttattaaaggagcagaattattagatatgttagaggttattccagaacaatatagaagtatgataaatgagtttattgttcctttgttatcgattgccgttattgctacaagttctatgaatataattagcgcagctttaatttctttagaagggaatcgtttatggatcattaaatcactaccaatcaaaacaaaagatattctagaaagtaaggtagcattacatttagctttatgtattcccccaggtttattattttcaattattggaagtatcgtcttttcattaaatattattgattgtttaattgtgataattgtccctgttgtttttacgatctttgaagcgttatttggtttgttagtgaacttatggaaaccaaagtttgattgggtcaatgaaacagttgttgtaaagcaaagtgcttcaattatgataacgttattttcaacaatggctttagtaatcttgataggtatttgttatattggtttctttagtgattttatgagtgctaaaatgtatgtaaatatgctattagttatatttgttattattgatttgggtctttattatttattaaatacatgggggattagaaggtttgaagagttataagctagaattcaattctagcttttttatcgtcaaaaacaatgatttaagatttttttaatatacatatttaagctgctgttttataataaagagggagggtagtaagatggcatttaattttaaaaacaaaattcataaagttcgtttttatggagccttagaacaagaacgagaacagaaaaataaacaggataatatagtcagcaggcggttgatcgttttgctttgtttcattgttgctattacatcagtcatggctgctagactagctttgattcagtttaaagacagcgatgaattagctgttaaattagaaaaatatggtactgctacatattcaaccgatgcccctagaggtgagatcgtcgatcgtaattatgttaaactggtacaaaatactaatgttatctgtgcaacttattatgcacctaaaaagatcaaggatgaacaattaaaaacatcggctaaatttttagcgaagacgataaatctagatacctcttctatttcaacccgtaataaaaaagattatttcattattgcatatccagatctagctgatgaattagtcagtgatgaagaaaaagctaaacttaaagagcagaataattatgacagtgctttattaaatcttcagatcgaacggatcactgatgagatgcttgaagaatacatggatgaaaacacattaaaatatacgcacttttattatttgatgaagagctgttcaagcggatcatcagtactagcagaagggatcagtgaagaagaagcaagtatcattggagaaaacatcgatatcctgccaggaatcgatgtaacgacagactggtcacggcagtatgtttacgaccgggaattcagtcaggtactgggcagagtaacaacgaaaaaacagggtctgccttcggaaatgaaaaatgaactgttagctttaggatatcaaaacgattccagagtcggggtatctggattagaagcacagtatgaaaatatcttgagaggaagcgacagcagctatacattgaattatgatagtagtggaaatccaattgttacaagtactaaatcaggaacagccggatcaaatatccgtctatcgatcgattgggagctgcagcagtttgccgattcgataatagaagaagaactggtcaagatgaacagtcaaaataaattctttaataagatgttttttacactgatggatccctacactggtgaaatcattgtgatgtctgggaaaatcatcaataaagagaccggagaagtaacagattatgcagctggaaactatttagatgccaatttgattggatcgacgatcaaaggaggaactctttatacagcgttcaaagaaggggtgataacaccagggacgacctttatggatgaaccaatcaagatcaaaggaacgaaagagaagaaatcacatcgagatttaggactgatcaatgaagtagatgctctagcatactcatcaaatgtttatatgtttagaatagcgatgctgttaggaggagcaaactacgtatatgatggaccgctaaagatcaatgatgaagcttttgaaaccttaagaagagatcttggagaattaggcttgggagtaaagacagggatcgatattcctaacgaagcgtttggatatagaggaagcaagcgaactggaggatatttattagatgcttcgatcggacaatatgatacatatacaaatatccagttagcacagtatgcctgcacactagcaaacggtggaaagagaatcaaaccgcacttatttttagattcatatgtaacagatgctgatggattggcaaatgccaactatacagttaaaacagaagtgttagatgatgtatctggtcaaacgacagcctttggtcaaatcaaacagggaatgagagcctgtgtaacaagaacaaacgggacatgtaattcttactggagcagtaaatcctatgtgacatatgcaaaaacggggactgctgaagattatacgggaacaggagagaccgattatccaaaccatttacagatcggatatatccaggcagatgaaaactctgaaccaatcgtagcctttgcctgtatcgcgatacgacagacaacagcatcaaatggaagcagcagttcagcaccgttgatttcacaacaaataattgataaatatgtagaaaagtatggtttaaattaagttttagaataatgtgaagattcttatatatcaagaatcttcacatttataaataataagttttttttattagcgttaaagaattattttaaatcaagaaagaaattcaatttttatttgacaaaatattttttagtaatataatagtaaccaaactcgatgactaaaagagtagttttgatgacgatttttagcgagctgatgtgggtggaagattggcagtctaatcaaaatgaagcgcatttacgagaggaaagtgggaacttagagtatcactttcgggcaatcacccttaacgatgaaagagatcatagggtcaacttatgataaatagagtggtaacgcggttaatttcgtctcttgtttaagagacgtttttttatattaaagaaagtggaggactaaaaaatgattagagtaggaattgtgggatcaaccggatatgggggatgtgagttagtacgatttttattaacgcataaagaagttgaaattaagtgggtttcatcaaggacatacactgatcaagaatatagttttgtttatgctagttattttaagctgttagatcaaaaatgtgttgatgaaaacatcgaagattatttagatgatgttgatgttgtgttttttgcaacacctcagggagtgtgtgcaaagatggttaatgaaaatgttttaagtaaagtaaaagtgattgatttaagtgctgattatcgaattaaaaatgtagatacttatgaaaagtggtatggaatcgaacatgcttctccagaatttatcaaagaagctgtatatggattgtgtgaaattaatcgtgaacaaataaaaaaagcgcgtttgattgcaaatccaggctgctatccaacatgctcgatcttaacgatctatccgttagccaaagcaggattgatcgatatggatacattgatcattgatgctaaaagtggtgttagtggcgcgggacgtggcgctaaagtggctaacttatattgtgaagtaaatgaaagtattaaagcatatggggttgcgagtcatcgtcataccccagaaattgaagaacagttaggttatgcttgtaatcaggaagtattattgaactttacgcctcatctagttccgatgaatcgtggtattttagtaactgcttatgcaaaattaaaagccggagttagtaaagaagatgtggctaaggcttatcaatgttatgatgatgagtattttgtaagagttttaaattctggagttttaccagaagttcgaaatgttaaagctagtaattttgttgatattaattataagatcgactctcggactaatcgaattattatgatgggagcaatggataacttagtaaaaggggcggctggtcaagcaattcaaaatatgaatatcatgtttggacttgatgaaaaagctgggttgcttttagcgcctgcggtattatagggggatttgacaatgaaaataattgataatggaacagtgacttcaccaattggtttttttggagcaggagcccatgttggtataaaaaaagagaaaaaagatttagcgttgatctatagtcaagtcgatgctaaagcagtcggtacatttacacaaaatattgttaaggcggcaccggtagtatgggataagatgatcgtagagaactatgatcatgcaagagttgttgcaatcaatagtggtgttgctaatgcttgtactggtgatgagggaatgaagtataatgaagagttcgctaaaagcgtagcagataattttagttttgaaaaagaagaagttttgatttgttcaactggggtaattggtaaacagttaccgatggataaaattatcgcgggtataccacaagtaaaatcattgttaagtgatagtgaagaggctggtatgatcgtagctgaagcaattatgacgacagatacaaaaccaaagcatcttgcagtggaaattaaacttgatggaaagaaagttactttgggtgcttgttgtaagggttcagggatgattcatcctaatatggcaacgatgttagggtttattacaactgattgtaatatttctaaagagttattaaataaggctttaaaagaagtaattcctgatacttttaatatggtatctgtagatcgggatacttcaacaaatgatactgtcttactattagctaatggtttagctaataataaagaaatcgttaatgaagatgaagattatcaaatttttaaagaagctttatattatgttaatgaatatctagctaaagctattgctggtgatggcgaaggagctactaaattattggaggtacaagttcatggtgccagcagtattaaacaggctaaagtgattgctaaaagtgtttgtacatcaccgttagtaaagacagctgtttatggtaatgatgctaattggggaagattattatgtgcaatggggtattctggtgaagaatttgatccttataatgtggacttaagtgttgctagtgaatttggtcagttgcagttagtatctaagggaatggcaacagattatagtgaagaaaaagcaaccaagatattatcaagtagtgaagttaaagcaattattgatattcataatggtgattttaaagcaacagcatggggttgtgatctaacttatgattatgttaagatcaatgctgattatcgttcgtaagggggaatttaagtgcatacaagagaacaaaataaagctcaagtattagttgatgcgctaagctatattcaaaaatttgctggagatacagttgttattaaatatggtggcagtgcgatgacaaatgaagttatcaaacagtcagtattaaaagatatcgcagtattaaaatcagttggaatcaagccggtaatagttcatggtgggggaaaagatattaatacttggttaaataaggttagtattgaaagtgaatttaaaaatggtttaagagttactactaaagaaactttagaagttgcagaaatggtactatctggaaagttgaataaaggactggtacagcatatggaaagaattggtacgcatgctgtagggttatcaggtaaagatggtaatatgcttactgttgaaaaacatttttctaaaggtgaagatattggctgggtaggtaagatcacagcagttgatactgatttgattgaaacgttattgatgaatggttatactccaattatttcaacgatcggtttagatgaaaaatataatgcttataatattaacgctgatgatgtggcaactgctattgctcgtgctttaaaggcgagtaaactagtctttttaactgatattgaaggggtattgaaagaccctaatgatcctaaaactttgatttctaaaattaataccgcttcagcaaaagtattatttgaatcaggaattattcaaggaggaatgattcctaagttacaaaactgtattgatgcagtacaaaatgatgtaaataaagtccatattttagatggtagaatggaacatagtttgttagttgaaatttttactactaatggtgttggaaccgaaataaaaaagtaatctcatcagattacttttttagtgtaattatattaatttggttagggcaaaacaatcgatattcataaccattttccatacctaaaccattagaaataaccaattggcttttgtttttagtatagtagccatgaacataattttgaccattactctttttaaataaaccaccaataccaggtaaataaatataaccgcccatcgtatgaccagataattgcaatgcaatattacttttagctgtagtatcaaaataatctggttcatgaacagctacaagtttataaatatcttgattgttttcgttgatcaaaccggaaatatcgccactgctttctagaccgaataacccaattgtcgcattattgaaataaatggtacgatattcattatgaagaacttcaaatccaccttcatttaaaatacttgtaacatcatttagtgaagcgagatctttttcacctaacacagcaaatttaccataacttgattttatatttgataatacttcaattactttttcattatcaaatgggatatctgtaaataaatcaccaccaaaaataaccatatcaacatgctgattatttaaagatgtcacgattttttccaatctagtaatatcactactattttgaagatttatatcactaataaatccaatttcaaaatttgcaaactcattaggaagactactattattaatagtagtttttttgatcgtataatcatcaggggcgatgtaatgactatgataataaccaaaaccgccaccgataatcataattactaataaaagaaatttaattgttcttattttttttctcatggttttttattcatgataaccggaatgatcatcggattacgctttgttttacgataaaaatatgaagataagatatcccgtgtcgtattctttatttctccaaaagtagtttttccttgtaataacttagataaagaactttcaactaagcgttctgcttcacgaatcatatgaaaactgtctttcatataaacaaatcctcgagaaataattactggatgtgtcaataattttccggctctagaatccatactgatcaagatcgaaaccattccatcttctgaaagaatttgacgatcacgaagtactgctgtagataaaccactgatatcatttccatcaacataaatgtcttcaacatggatccgtggtcctaaacgtgcttcgccgttatttagtaggattgtatcaccgttagaaagaacgaatgaattttctgctggcacaccaacttcttgagataaggcagcatggatttttaacatccgatattcaccatgaactgggaaaaaatactttggtttagtaagcagcatcattaatttttgctcttcttgggatgcgtgtccagaagtatgtagattattgaaagcggtatttgttaaaactttggctccagctctaaataatttatttacaacgacattgacactataagcatttccaggaattggatttgacgaaaatacaactgtatcaccaggtttgatctttacatatttatgagttccattagcgattctgcttaaagcggctaaagcttcaccttgagaaccagtacataaaatcaatatttcattgtcaggtaattttttagcctgatcatttttgatgaaaaatttatcagggcatttaatatatcccatggctctagaaacttggatattattttccattgaacgaccataaacaagaatttttcgattaaatttaactgctgcttcaacgatttgctggacacgatgaacgtttgaagcaaatgtggcaacgatcaagcgaccttcagtttttctaaattcttcctggacgctgttagcgactttcttttcactgatagaaaaagtaggaacttcagaatttgttgagtcactcattaataaagtgacaccagtttcacctaagaaagacattttttgatagtcagcagcatctcccactggagataaatcaaatttaaagtcaccagtttcaacgattctaccattaggactattgacgatgattcctaatgattcagggatagaatgattggtcttgaaaaatccgatattaaaatacttagatttgatttggtattcatcattgatttggatgatcttagtcacattagttagccttttttcatctaattttcttttgatcatcgcactagctaacggagtagcataaataaaagggattttaacgatctgtaataaaaaaggaattccaccgatatgatcttcatgaccatgagtgatcattagaccgcggatctttttttcattgcgctttaaatatgaataatctgggattacataatcgattcctggtaatccttcttcagcaaatttaactcccgcatcaataataaataactcattatcatgttcgatacagtacatatttttaccaatttcattaagtcctcctaaagcaaatactttagtatcgatactattacgatttttgttaattgtttttctagtagttttaggtttattataatttttttgattagttttgccagttcttctattatttgtatatggcttttcttgcataatttcctccttatttatattttatcttctttttataattattataacatataaaaaggcaagaaacgaagtttcttgcctagataatttttttacatgccgcaactgctagtgcatgtggtccaatatgacatgaaacacttaatgataatgggtcacagattatagtagaatcaggatagatttcctctaattcttttttcaattctaatgctggttgcttgtcatatgtataagctacacagacatgcacatttttccctttttgttcaggatcgatacgttcatcaatatctttttttatcgcttcaatcattatttttgttgcctttgacattgttcttgatttactaaaagtatcaagcttttcaccttggatctgtaaaatcggtttgattttcatcattcctccaaggattgcaacagcaggagtaattcttccgcctttacgaagatattctaatgtgttgactgtaatatagatagaagcgtttaatttatttgtttcaagaatttctttgatttctttagctgatttcccttgtttggctaattcgatggcatcaaacacatcccacttttgagtaactgagatcctttgagaatcaacgacttgaactcttccatcatactcgtttgctaacatcaacgccgtttgacaagatccacttaaaccactcgacattggaatatatactatctcatcataattttttaatacttcatcccatagtttaccgacatcaccaactaaaggctgacttgtaaaaacttcagcaccatttgttagtttatcaaaaaattcactatgtgttaaattaatatcttcatagaaggtctggccatcaatagtaaagggcattggtaatacattaatgcctaactttttaccttcgtcttgtcttattccagaattactatcagtgataattgctactttactcataaaaaacctcctatctctaaaacatattttacttaaaataataaaaattgcaaactatttaagtattattaataaaatatttgtatttagccattaactgtattgtttattgtaatacagtttaaagtctgttatactattagtgcgaggataagtttagaaaggagtcagcatgaaaatagacagtaatagtgcaacaccgatttatgaacaaatttataaacagctgctagaatatataaccacgggattgatgcaggcagatgataaattaccttcggtacgagaattgtcttcatcgattcatattaatcctaatacagttgttaaagcttatcgacttttagaagaacagggttttatatattctttaccgggtaaagggagttttgtcagctcaaaacaaaatgttcaaacgaagttgtttttacagcagatcaatgaattgacacatgaaatagtgactaaaagtaaatacgtgggaatgacttttgaacagttgtgtcagttgctggaacaaaaatgggaggataaataatgttaatagtaaaagaactttcaaaaaaaatagataacaaattaattttggacaatattagtttaaatatacctaaaggctcaatttatggtattatcggtgaaaatggtgctggtaaaacaacattgattcgtcatatcgtcggagcgtatcagggcgattacggttttgttgaattagaaggaatgcgtgtttatgaaaatagtgaagcaaaagcaaagttagtatacattcctgatgaattttttgatacatttggtcataatattaaaaatcttaaagaactttatcagggaatctatccgacttttaatgaggaacgatactttaaattaatgcggttgtttaagcatgacagcttagaaaattttaataaattttctaaagggatgaaaaagcaggtaatgtttatttttgctctttcaatcatgccggaatatttaattatggatgaaccgtttgatggtttagatccgcatattcgtaaaataatttgggatattttgattcaggatgtaagtgaacgacaaatgacgatctttatttctagccatcatttaaatgaactagacagtatgtgtgatcatattgctttgatcagtgatggaaaaattattttcgaagaggcgcttgatcatttaaaagaaggttatcataaattacagatcgtcttagaatcgggtgatgatatgtatgctttggaaaaagagctgaatattttagcccatcagatgatgggacgggttcatactttgattgttaaagggaatcttgaaagtattgatatgatagtatctaaatatcatccgatcataaatgaaacattatcattgtcattagaggaaattttcttatttacgctgggaggaaagtatgatgaactcaaggacgtcatgggttaataaaacactgcttagaagtgttgtcaaaaataatctttttccagctaaagtttcattaattgtttttgggggattttttatcttggcatcaatagctgttgatggaacaggaatgggacagttgtgtgttgttgtttatgcgatcagcgctgttgttttaacaacagtatatccgagttttattcaaagttatatgatcgataagacaaaagcttcgatagtaaaagcattgccgttaagttctaaatgtatttggtttactaattatttagctggttatttaattgttttagttacgcttttaattgaaggtatcggtgtgatttttgttgatttttttaggtcgtatacctctgttgaaagtattttgttttatcgctttatgttaatgatttttgtgttattgtttatttattatacgattacttatttagctgccagtatggccggaaatcgtttgggtcagatcatatttagtattgtcgcttatacattgccagtagcattgttgttgagtttaattttgttttctgtttatttagtgccgggacagatcaatcaaattggtgatcgttatgctaaattagtgtttccggtttttgcgggactggaatttattgatacgggtgataagacgatttttattcattgtcttggtgcaatggtatttttggtgataagttattatatttatgtaaacaggaatgatgagtatattggagaaccgctggtttttcgtaaaattggactgattttaaaagcgggaatcatgttgattgtaacgattgcaatattttatttgatcttacttatgaatcaaatagatattacttttgggttaaatggggttttagatttattgttgatatacatggtaattggtgtgatcatagcgatttttattgagattatttttaaaagtacttatatttatcgtaagttattgatctatattcccatcttattgatcttttttggctttaattatgcgtttgcaaatactcaatatcaccaggttgtttctgaacttctttcaaaagaaaagatcagtggtgatctttatatcaataatcgaaaaaatgatgtgttgttaatgaatcttgatcgtgataatttgtcggggttgattgattatcttaatgataatctagatagtgttcatgttctggaatttggaaatgatgatgttttaataacccttaatttatatgataattcagatgatttttataaagatagcttgcattattattttgattttaaagttatcgtagattactttaataaatcaggtagtgattatttaaataatacgcttagagattttgaaaacaaaaaatatctaacttgttattatcaagaaaaaagtctttatctaagtccagaaaatattgatcagctttatcaaataactaaagatcaaaaaataactgctgatgatctaatagatgcaagtatgcttaatttaagcagtgatgatggttatcaatatataattaaattaaatgatcaggttaaagaatttttagaatatgattcaataatcaaacagtctgaatttgttgatgattgttataactatatttttgataataatttattagtggatcttgatagtccaatagctaagtttatagaagatgagttgcttataaatgatttgacttctttatatgatgatgttgttgaattaatagaatttgataataattatgttatatatcgagcaaatgtaacagctttaaatgaggatgatagttttgaaattagtttggatttgaagtttgtaaaatcaaatggtgaaattattattagttcaattagaaaggctggtatataaacatgttaagcttatttaaaaatgatttaaaacagttaaaagatttctttgttatttatattggctgtctagttttgaattttattattagtggattatcatataatcaggatattgctgtaattactttttatttgattgtttttgtctttaccttgatcatcccgacgatcaatttaagacatttgttcagtgtggctaaagaaacatattataactctttacctttaactagactgcgaagctttatgattcattacttaagcggaatcatttgtttgattgttccagttataatttattgcgttttacttcaaggggattttttgaaaaatagtctagcgctgttattaataattcttttgtattatacattatctaatttatctgcttatttaacgacgaccctttttatgcatatagttttacagatggttattatctttgtaccgatcgtactttattttagtttatcattggtatatgcttcatttatcaaaggggttgtttatgacgggatgtcattagatatgataggtagtttaatgccctttatcaggatagctgcagcagctagtgttgatttagaattaaattattttatttatatcggatatctagtggttagttttctattaactttatatatatgtaaaaatcgtgatcgtagtaataattaccagggatttacttataaaatcgtcgcccaaataattaggcttatcatcattataagcggatcatggctgttagcttcattgttaggagtcagctcagcttcaataaaaacctttgttataataaatattattgcaacagtaattgttacttttattattcaattcattcattttaaaagaattaaatatcaattatgtattattcaatcagctttaattgtttttgtaacagtagttgtttttgcgggctctaaaaattatttagaaaattatattcctgatgcagttgatgctgtagtgatcgatcaagatgctgcaggagttaaatcagatattcggatcactgatgatcaggagattgccaaagtaagcaagattcatcaagaattgattgaatcgagtagggttgatgatctgccaagaaaaataaatatcacttattattgttctaatggaagtaaagtagtacgtcggtattctgtggaacatactgaatatgaaaaaatcgttaatgaaattgataaaaatttgattaaaagctggaatggtaaatattatcaattattggaaaagatggataaatgccaaaaaattgaattctttaataacgaaaattatgttattgattcaaaagatgagttacagcttttgaaagaaatattacaacgtaaattgacagactttgaaaatgatcctagtttattaaaaaatgtagtttctggtgaggaattttggtgtaatgtgaattttaaaaacagttcttcaatgtattattataatactaatgatcctatgtctttagctttagcggattttaataaaataaaagcaaattagttgtaattattttaatatcaggcataatgttaattagaggtgagaataatgaaaatattaaatagtaatgaatttgatagtgctatcgctaaaggattagtattagttgatttttatgctgactggtgtggaccttgtaagatgttaggaccagtattagaagaattagcgaataaaatggatcaagttgatttttataaattaaatgttgatgcttcatcagatatcgctggtcgttatggagtacaggcaatacctaacttgattatttttaaagatggtaaagcggtagatcaaattacaggttttgttcctgaaagtgagatcgttagtcatttagaaaaattactttaaaccatggaagattccatggtttatttatgttataataaagatgttaggagggatataaatggcacgaaaaccccttaaattaacaaaaaatgcattaatgctgattggtatgatcgtcttggttttagttgttttgatcgttttgaattttggtaaagcaaataatgagattgtaaaaccagtagaagaagataaagagacattaagttcattagtagttgaaaatcaggttttaaaagtagaactgctggaatttgtttcggctaaaaattttgatgatagttatcaggaagtagcgatggatattgctgccaaagaagaaatacgtggttataaaataagtactaaacaggaatttaataaaattatgcgtttattaccacctggagaagagtcaccattattgaataacagtagtgagatgccgactcatgaggcttatattttagttttaacgggtgatattgctcaatataaaaatagtaaaggtgaagatgtttatcgaatcgtcaatgccagattagattattgtaaacagtcattattattagaaggggaatatgacagtgtttatattgcttcggttgatggtaagaaagaaaaaatggttaaaatggatgattataaacaggctttatctagtgtagatgaatatatgtcaatgttacaatggtaatgccctagcgtacagctagggcattatgcttatcaattgtttaaaccagcaacaaatgttagatcgatgccaaacatgatacctgtattgggattattgattccttctaaagtttcatcaattatttttctgactttagcaacttcatcgttttttaaaataaagaatagtgttttgctagtttcacgagggtcttctagaatgattcgtaatgattcgataataaagttatcgctgctttttaatgcattgaccattcctttgctttcaatgatcgtgccaccggttataccattattttgtaaagctactaataaatcatctaatttttcagttttgtgtaagactaaaaatagtgcctgcataaaaaaatcaccccttttaatcattataaactaaactaatgtgctttgcattaagaaatgtttggtttataatagtcttataacataagggggcagaaagatgaaatttgaattttcaaaacgaatcagcggtgttaaggcatcagcggttagagagattttaaaaatgatgaaagatccagaaattattagttttggtggtggaaatccagctagtgagacttttccggttgttaaattaaaagaaatcagtgatgatatttttaataacgagccgaattcagtcttagaatatggaattacagaaggtgataatgattttaaagaagaagcaattaaatttttatcacgtcatggaaatattgttaatgattatgatggggtaatggtaacttcaggttcgcagcagatcatggattttatggcaaagtgcttgtgtgatgaaggggatgtcgttgtttgtgaaaatcctagttttttaggggcgttaaatgcttttaaaagtaatggggttaaattagttggggttgatatggatgatgatggtattaatatcgctaaattagaagaagcgttaaaaatgccaaagagacctaagtttatctatttgattcctaattttcaaaatcctaccggaattacgacttcattagaaaaacgtaaagcaatctatgcattagctaaaaaatatcaggttttgattttagaggatgacccatacggtgatttaaggtttagaaataaagctattccttcaataaaatcattagatgatgaaggattagtagtatatgcagctagtttttcaaaaattattgcacctggaatgcgggttgccatcatggttgggcatcaagaactgcttgctaaatgtacgattgctaaacaaacaaatgatgttcatactaatgcttgggcgcaaagagtaatggcgcgttttttgcaagaaacagatatggagcagcatctaacaaaattacagcaggtttatgatgtaaaatgtagtttgatgttatcagaaatggaaaaacattttagtaaggattgtaaatggacaaaacctgatggggggatgtttatttgggttactttaccagaaagaatcgatatgccagctttcgtccaaagagcattaaagcacaaagtagctgttgttcctggaaatgctttttatgatgatgataataaacgctgtcagtcatttagaatgaatttttcaatgccgactagagaacagatcataaaaggggtagcgattttaggagctttaacaaatgattaaaaatattgtttttgacatggggaatgtgattttaagatgggatcctgaatatatcgctagtaaattgagtgttgatttaaatgaacaaaaaataatcaaaaaagaactttttgaaagtttacagtggcgtatgctggatcaaggtttgattagcgtagataaagctttaaaccagatatatagtcagagtgataaacagtatcatgaagtactaaagtatgctttaaatcattggtatgattattttgaagcgattactgcaatggaacctttggtaaaagagttaaagcaaaagggttttaaaatatatttattgtctaattgcagcttgcagtttgatgattattatcaaaaagtaccagcatttaaatattttgatgatttttatctttcagctcgtcatcaattggtgaaaccagatttgaagatctatcagcattttttatcggagtttggtttaaaagcagatgaatgtgtttttattgatgatattttagaaaatgttgaaggagctaaaaaagcggggatcgaagcatattgctttgatggtgaagtagataaattgcgtttgtttcttgagaaaaatatttaggtttataattattaataattcttaaaaacactttgcttataggtgattttagttgacaattagagttaaaatgctagaatgcatgtagaaagaaaatataatatgtaaaaaaggcaaaagggaattatgaataatatgagtaaaggtgaaatggttttaaataatggagataataagcgaaaacgcaaagttcgtaaagaatttattgttatcatggttttattgatggcgattgttattgtttattttataggggctttttattttaataagaaatttctgaatggaacttatatcaatgatgtaaatgtaagcggtctaactgtaagtgaagcgaatgaaaagctttcgaaaacagtcgatgattattctttggaattaaagtttaatgatggaacttcagagtttgtatcaggtaaagatttggggataaaatataatagtgataatgatatcaagaaagttataaagaaacaaagttcttttaattggattcaagctttttttactaaaaaaaataattctgtcaataatttagcgttacttgatgaaaatattttaaaagacaagatcttatcattaaatcatttgcaagaaggagtgcaggtggcaccagaagatgcaaaagtagaatatgttgacaatcagtttacgattaaaaatgaagttgatggttcaactattgatcaagaaaagacatttgaagctatcaaatcagcttttaatgaaggtaaaacaagtgttgatttacaagaacaaaagtgttatgtagaaccagctgtaagggcgagtgatgccaagattcagcaattatatgaagctgctaaaaattatgcgtcagctgtaattacatataaaacaaattcaggtgatgttgttttagatggcaatacattaataacttggctttcgattgatgaaaacggcaattattatcgagatgatgatgtttttaaagaaaaggttactgcttttgttaattcgttagctaaaaaaataaatagtgttggtggtacgcgaacatttgttggagcgaataatcgcactattactgtaagtggtggtaattatggtttgcgattacaaacttctaaagaaataagtggtttattagaagatatatatgcaaataaagtaggggttagaaccccagtaacaagcggtaaagaaagttctactgataatggtggtcttggaaatacttttgttgaaatagatctaaaaggtcagcatatgtggtatcataaagatggtcagataattttagagtcagatattgtttctgggacatataatgatccagaaagaagaacaccagcgggagcgtattatctttataataaagaacgtaatcgtgttttaagaggaacaaaattgccagatggcacttggccatatgaaacaccagtatcttactggatgcctttcaataaagggattggactacatgattcatcttcatggcgtagtaaatggggtggaacaatttacttgaataatggttctcatggttgtgtaaatctaccaactaatatagctgcaaagttatatgacaatattgaagttaattgtccagtagtttgttattattaacaagtaaattattgtttagatgtcctatttttgattattttgtcaatcttttagtgattagttaagaattgtatgttataattgagtagtgacattggcatatgttatatgttgaatgtttgtaatggtatagttagattgtaatataaatatgattttagtggaggagaagttgaaatgagcaacaaaaagagaaatataatggatataattaataaagcagtttttgtagaagaggagatagaagaagtagtagaaaagaaagataataaatctttagctgaaaagaaaattgaagaaagaaaagtagaattaaaaaatagagagccgaaaaaagtagaaccaaaaccagagaagaaagcagaaaataaaacttttaatgtgcctagagaagaacctgtttattctaaacctcaaaaagtgcaaccagaatatgctgcatctgttatttcatatggaactaagatttctggtgatattacttgtaaagcagatttacaagttgaaggtataattgaaggaaatattatttgtgataaagcagtaacgatcaaaggtaaagttaaaggtaatatcaaagctgattcattaacaactatcgatgcaacgatcgttggtaatgtaaattgtcaaggtatcgttaatattttaggtaagactaatttacaaggtgatgttaatagtagtgatgttgtattagaaggtgaaatcaaaggtaatatcattgctgaaaacagagtatcattaaaaggaacttctgttttagacggaaatacaacttctgctaaaatcatggttgaagaagggtctacaattattggtagcattcaaactgtttcaaataaaaaaggtgataagaaaaactaagctgagcttagttttttatcttttctattaatatttaaaagtatctgttataatgtctaagtgatttataatagtaactttagaaaggaggatgtcgaggataaatactcgacagatcagatgttaagtaaatatcagaagatatctcaggatttaattaataaaattaagaatcatgaaataaaagctcatacatatttaccaagtgaaaacgaattgatgaaaatgtataatgcttcgcgcgatacaatcagaaaagctttggatattttgcttaaaagcggctatattcaaaaaaataaaggtaaaggctctttggtgctggatgttgataaaattgcttttccagtttcgggagtaactagtttcaaagaattagctaagacgatcaatggtgaggtaaagacggatgttattgaattatcacttaatcctgtcaatgaagtaataaaacatgaattgtatatggacagtggtaattactataaagttgaacgggttcgtgaaattgacggggagcgtgtgattcttgatattgattatttaaatgctaatattgtgactaatttaactaaagaaattgctcaaaattcgttatatgaatatattgaaaatgaattaggattaaaaattagtttcgcaagaaaagaatttacagttataaaagccacaccagaagaaaaaaaacttatagatatgaaagactttgatttattagtttgtgttaaatcgtatacttatttagaagatgcaacgctatttcaatatacgatatctaaacatcgacctgataaatttcggtttgttgaatttgctagaagaacacaattataatttttaaagagaggaaattatggattataatgattatttattacagcatgataaaataggtaaaagaatcaaagaaatagaaaatagttcaataaaaatagctgtttttcgttttattagcggggctgcaatgatactgcttttattgtgtggttattttttgaataaagattatttatatattggaacgtttttaatgttaggtgtatttgttgttttagttttttggcatactaaaatggcagatcgtttgatttatttaagagcaagattagtagtgattgaaaaatatattgcccgctttggtgataaatggaaagattttgatgaggatggaactgattatttagaaacgataacgggtgtcatgaaagatcttgatattgtggggaataattcattgtttcagtatttgaataccgcggttactttaagaggaaagaaaaaattattggataaattatcaagaactgcatttgataaaagtttaattattcaagaacaagaagcgataaaagaattaggaaataaagatgattttgttattgattttgaaacttatggaaagatgctgataaaacctaaagttgttgaaaaagttgttgaggaatttattgctggtattaatgatgatcataaagtaaaaagctggaatgttgtgaggtttatcataccaattttgacacttgtaattttaataatgtttttatttgaaattggttttaaattggctgtaataatgctgccggtcttgatatttggtcaatggcttattatgatcataaattttaataaaaacagtaatttgtttaaacaaattacagaattatctaaatgtttaacaagctatcaaaatatttgcgaattagtagagaataacgatttttcatcactacacctaaataatctaaagaataagttatcgcattctagtcaggcatttaaagaattgcaggcaatcgcttctgcaattaaacaacgaaataatttattagcgtcgctgctgttaaacggtttattgctttgggatgttaattgccgagaacgctatgaaatgtgggtcaataaatatggtgctcaaatagacgaatggatcactgtaattggtgaattggaaagtttgatcagtctacaagttttattaagaactaaaccacaaagcagttttgcagtttttagtgatgagctttgtttaacgtttaatgatgcttatcaccctttgatcgatggtaaacaagttgttgctaattcatttacaatggataaacaggtttgtgttattaccggttcaaacatgtcaggaaaaacaacttttttaagaacgattggtataaatttgatattggcatatgcaggtggaccagtattggcgaaatcttttaaatgttcattgatgagaatttacacatcaatgcgtttagtagatgatttaagtggtatttcaacgttttatgctgaattattaaggatcaaagaaatcgttgaagctaataataaaggtgaaagaatgattgctttgattgatgaaatctttaaaggaactaattctaaagatcgaatatatggagcaacggaaacagtcaaacagttatcttcaaaaaatatatttacttttatcacgacccatgattttgaattatgtgaattggagaatcaaattccttgtgctaattatcattttagtgagtattatcaggataataagatcaggtttgattatttaataaagaaaggtcgttgtcagtcgactaatgctaaatatttattgcaaatggtaggtattacaaaatagctcatgaaaataattttaaagtagttgaagtatcgtcaaggcgatacttttttagtgtaaaataattaaatataaaatatttattttggtattgacatacatgtacgtacaagttataataaatttgtaaaagatgtacgtacaagtttaaaggagagagaaaaagatgggaaaatttagtagtgatgccaaaaaattattggactatgtaggtggaaaagaaaatattaaagctgttactcattgtgtaacaagaatgcgttttgtattagttgattctgctaaggcagatgttgataagattgaatcgctggacgtggctaaaggaacatttacccaatcaggacaatttcaagttattatcggtaatgaagttcaagaattctatcaagattttgtggctgtaagtggaattgaaggagttagtaaagatgcagctaaagaggcttcaaaatctagtcaaacctggttacagcgaatgatggggaatttaggtgaaatttttgcaccattgattccagcccttatttgtgggggattgattttagggtttagaaacatcattggagaaatcaatttttttaataacggaagtcagagtttagccgatgtttcggtattttttcaaggggtatatgattttttatggttgattggtgaagcggtttttcatttgttaccagtaggaattgtctggtcgattactaagaagatgggaacgacgcaaatcttaggaattgttttggggttgacgttagtatcaccacagttattgaatggtttttcggttgctggtgctacagatattcccgtatgggattttgggtttgctcaagtgcaaatgattggctatcaaggtcaggttatcgccgcaatgatggcaggatttgtactagcttatctagaaatattttttagaaaaatcacaccagcagttattagtatgattgtagtaccattttgttcattggtgccagcggtaattattgctcatacagttgttggtccaattggctgggtaattggtaatggaattgccgatgtagtttatagtggtttaacttcatcatttggagtcttatttgctgcagtatttggattaatttatgcaccaatcgttatgactggtcttcatcatatgactaatgctattgacactactcttacgagtatgtttggtgggacgattctttggccaatgattgctttatctaatatcgctcaaggttcaagcgttctggcaatgtcatttctacagaagaaaaatgaaaaagcccaacaggtaaacgtaccagcttgtatttcttgttatttaggggttactgaaccggctttatttggagtcaatttaaaatatgtttttcctcttgtctgtggtatgatcgggtcagcgcttgcagcagtgatttcagtagggtttggagtacaggcatacagtattggggtaggaggactaccaggtattatttctatcaaatcagaagactggttagtttttttaggagcaatgctggttgctatagttgtaccatttagtttgacttatattgttggtaaaaagaaattaagtgatcttgaaactgagggaaagaaagtcagtgaagaagtgacctttgtttcaccttttcaaggtaagatgctatctttaaatgaagttgatgataaagttttttctgagggattgatgggtgatggttttgctgtggaattaagtgatggcaaagttgtagcaccatttgatggcaaagtaattatgactttcccgactaaacatgcatatggactaagacgtaatgatggtgttgaaatactgcttcatattggaatggatacagttgaattaaaaggtgaaggatttgaaagttatgtagagctcgatcaggaaatcagctctggagatgtaatatgtaaggttgatttagatttggttaaagttaatcataaatctttagtttcaccggtcgtttttactagtgggcaaaagattacattgtgtaaaaaagatcaaaatataaagatattagaaaaagatattattaatattgataattaaggagctaaaagagatgtattatggaaataaagtgatttatcagatttatccaaaatcgtttaatgatagtaatcatgatggaattggtgacattaatggtattattgaaaaattggattatttaaaagatttagggatcgatatgatctggatgtgcccgattttttcttcaccacaaaaggatagtggttatgatattaaagactactattgtattgatccgatatttggtacgatggaagatttagaaaatttaattgccgaagctaaaaagcgagatatttatttgatgtttgatatggtttttaatcatacttctacagaacatcaatggtttaaagaggctttgaatggtaatcaaaaatacaaaaactactacttttttaaaaaggggaaaggtgatcgtttaccaactaattgggattctaagtttggtggaaaagcttggaaatatgttcctgaatttgatgagtattatttacatctttatgatgaaggacaggctgatttgaattgggaaaatgaggaagtcagaaatgaattgatcaagatcattaatttttggttaaagaagggaattcgtggttttaggtttgatgttatcaataatattgataaacgtgcttttgaagattgtccaaaaggtattggtaaacagttttattgtgatcaacctaaagtccatgattatcttcatgaacttaataaacattcatttggtaaaatcaaagaatgtattacggttggtgaaatgtcggctacaagtgtagaaaattgtattggctacacaaatcctgataatcaggaacttgatatggtctttagttttcatcatttaaaagttgattattttaataaagaaaagtggactattatgccttttgattttcaagaactaaaagaattattaaatacctggcaggtaaaaatgcaagatggtaatggctggaatgctttgttttggaattgccatgatcagccgcgcagtgtttctagatttggtaatgatcaaaaatatcgtaaattatcagcaaaaatgttagcgacgacaattcatttaatgcggggaacaccatatatttatcaaggtgaagaaattggcatgacaaatcactatttcaccgatattaaacagtatcaagatgtagagagtatcaatgcttatcatattttaaaagaacaagggcttgatgaaaaagagatccataagatcttacaagaaaaatcacgtgataatgctagaacaccaatgcagtgggataatagtatcaatagcggtttttctgatgtgaagccatggctggaagtaaatgaaaattatcatgagatcaacgttgaaaaagatttacaggataatgagtcgatttttaagtattatcaaaaattaattaaattaaggaaagagtataagatcattagtgagggaaaatatttgccaatgatgaaagatcatccacaaatatttgcttataaacgtattttggataatcaggagttaattgttttggataatttttatgatcaggaagtatctttagatttagatttaagtgattatcaagtattgatcaataattatgatgatatttgtagtcattgtttaaaaccttatcaaagtatcgcaattattaaaacaacatcttaatggtgttgttttaataattttttatttttatataaaatttaatgcaaaatcgtgcaataattacataaataaagtagaatacaaaagataaagtttaaaattaacgaaaaattaaaacaataaatgtatagaggaaaggagaaatataaacctttaggggttatatacaaataatatatgaaaataggatttgataatgataaatatttaatgatgcaatcatcacacataaaagaaagaattgctcaatttggcgataaactatatttagaatttggtggtaaattatttgacgattatcatgcttctagagtgttaccaggttttgcaccggatagcaaattgcaaatgttattgcaattaaaagatcaagctgaagtcgttattgccatttcagccagtgatatcgagcgtaataaggtacgtggtgatctagggataacttatgataacgatgttttacggttgattgaagtttatcgtagtaaaggattatacgttggaagtgtagttattactcagtatgatggacaaaaagctgctgaggtatttaaaagccgtttagaaaaaagaaatatcaatgtttatttacattatttgatcgatggctatccaacaaatactaaaaagatcatcagtgaagaaggttttggtaaaaacgattatattgaaacaacaaaacctttagtagttgtaacagctccaggtcctggtagtggtaaaatggctacttgtctatcacagctgtatcatgaacatattagaggaatcaaagccggttatgccaagtttgaaacatttccaatttggagtattcctttaaatcatccagttaatttagcttatgaagcagcaacagctgatttaaatgatgtcaatatgatcgatccttttcatttagaagcatataataaagttactgtaaattataatcgtgatatagaaatctttccggttttaaaaaatatgtttgaagaaatctacggggttagtccttataattcaccaaccgatatgggtgtaaatatggctggtttttgtattagtgatgatgaagtttgtaaagaagctagtcgtcaggaaatcatccgtcgttattaccatactagaaatcgctatgttaaagaagaatgcagtttagatgaatttaataagcaggaactagtcatgaatcaagctaaagttgttgttgaagatcgtcgttgtgttgcagcagcgaatgaaaaagcaaaagcagtaaattgttatgctggagctattgagctggatgatggtacgatcatcactggtagaacgaccgattttatgggatcatgttcagctattttgatcaatgcgattaaatatttagctaagattcctgatgatgcgcatttgatttcgccatcggcatttggaccaatacagcatttgaaaacagagtatttaggaagtattaatccacgtttacatagtgatgaggtattgattgctttatcgttaagtgctgttgataatgaaaatgctagactagcgttatcacaattaccaaaattaaaagggacacaggcacatgttacttctacgataggtccaatggattctaagatatttagcagtcttgggattgaagtgacttatgatgctaaaaaacaataatatgttttagatcgatattaaagaaaatggattgtttcgtacatgaaacaatccatttttcagaaaggaggtgtattacaccatacaaatgtatcatctaagattataatatatgttaattaaaaaaatttcaataaatatgataatttattgttatcataatcaaatttgtattataataagttaaatcgcaaccaatggttgcatagatgataactaaaatatctagaacaactaaacattttttgtcataataaaagtgtttaagggaggtatatgtgtgaatatagaaattgctaatcgtttagtcaaattaagaaaagaaaataatctttctcaagaagctttagcaaataaattaggaattagtcgtcaagcagtaagtaaatgggagcgtgctgaagcctctcctgatactgataatcttatttcgttatcaaagctttatggtatttcattagatgaattattaaaaactgatcaaaaagaatttgaaagcggcagtgataaaaaagaaaagacagatactttgaagaaagatgaagtacatataagcttaaaacatggaatccatgtaagtgataaagatggtgatgaagttcatattggctgggatggtatccatgttaaagaacgtgctaaaaatcaagatgttcatgttgatagttctggggtaagaattaatgataaaacatatagtcatgatgaatggaagaaacagagcaaagataataattggtctcattattatgaaaattatacaaaatttccttttgcactgatcattatcgttatttatttgatcatggcattttatacgggaaattttcatcctttatggataatgctgctattgattccgattattgaaggagcaatcggagcaatcaaacatcgtgatttaaatcgttttccatatcccgtattattgattttatatttcttatatgaaggtttttgttatgatgtttggtcaccaacatgggtagtgtttttaactatcccagtttattatgctttggtgaattattttaaatatcgtcaaaaaaataaaaaataacggaaagattttttacagttgatgaataaatcagctgtttttatttaaaatgttaaatatagtagtttatgatattttatttttgctatatattttacttctatgttataataaattaaacaatggtgaaaccattggaaaatagaaaaggagggggcttatgaactttttatttatttcacctatgtttcctaagtcatattggcacttttgtgatcggatgaaacagcgtggtgtaaatgtattggcaattggggacatgccatcagaaagtataagtgacgagttaagaaattcagtaactgaatattgttatgtaaacaatatggaaaattacgataatgtatatcgttgtgtggcatatttagctagtaaatatgggaaaattgattggttagaatctaataatgaatattggctggaattagatgctagacttagaacggattttaatatcaatacgggaatgaaagaagacgtgactaagatttttaaaacaaaatcaggaatgaaagcttattatgaaaaagcaggggtcaaaacagcacgttatcatcttgttgatactattgaaaatgggaaaaagtttattgctgaagttggatatccagtagttgttaaaccggataatggtgtaggggctgctgctacatataagttgaataatgatcaagagttagaaaatttttatcaaattgatcatattacgcaatatattatggaagaatttgtcaatggtttgattatttcttatgatggtattgctaatagagagcatgaagtattatttgagacttcacatgtttttcctaattcgatcatggatgtcgtaaatgataatagtgatatgcattattattctttaagaaaaattcctgatgaattagttaaattgggaagaagtgtagttagggaatttcctgtcaatggtagattttttcattgcgaatttttccaattattagaagatcgcccaggattaggaaataaaggagatttcattggcttagaagtcaatatgcgaccaccaggaggttatacaccagatatgatgaactgggctaatgatattgatgtttataagatctatagtgatatggttatttatgataatagcgattattatacaaatcgcccttatcattgtgtatattgtggacgacgtgatggtaagaattattattacaataatgatgctcttgtggcaatgtttggtagtcatattgtaatgaatgaacggatgccggatattttatcgggagcaatgggaaattatacttatacagcacgttttgagacgatggaagaagttaatgattttatcgataaggtattacaggaggcatagtgatgaaagttgaatattttaaagaatacagcaattgtttaaatcgtgaaatggaatttaaaatttatggtcatactggaattcctttattagtttttccggctcaagatgggcatttttatgattttgaaaattttgggatgatcaatgtaatcgctgataaaattgaatcaggtcaaattcaagtattttgtttagatagtattgatggtgaatgctggtctgatgaaggtggcgataaccaacatcgtacatatatgatggaacaatggtactattatgtagtagatgaattagtaccaagaatctttgatattaatggaactggtaaactcatttatacaacaggatgttcaatgggggcaactcatgcagcaaattacttatttagaagaccagatttatttcaaggatgtatttgtttaagcggttattatgatagtgatctattttttggtgattatcatgatgaaatcttatacaacaacagtccaattcaattcttaaatggaatgtcttatgatcatccatatgttgaaatgtatcgtcatcgtgatattattttatgctgtggtcaaggtgcatgggaagatgaaatgatttattctacaacaagaatgaaagaattgttggattataaagatattcctgcatggatcgatttctggggtagagatgttaatcatgactgggactggtggcaaatccagttaccgtattttttaaatcatattttataaaagggggatattagatgaatgtagtgtttatttcacctcatttcccattatattttcataatttttgttcacgcttaaaaattcgtggtgtgaatgttttgggaattggtgatgcaagttatcaggaaattagtaaagagactaaagatagtttaagtgagtattatcgagttgatagtttagaaaattatgatgaagtttataaagctgtagcttattttattagtaagtatggtagaattgattttattgaaagtcaaaatgagtactggttagaaactgatgcgcggcttagaagtgattttaatgttaatagtggtactaaatttgaagatttggcggtaatgaaatataaatcaaaaatgaaagctgtttatcaaagtgttggtttaaatgtcgctagatactgcttgatcgatacttttgataacgcattagcttttgttgaaaaagttggatatccagtagtagttaaacctgataatggtgtaggagcaacatcaacatataaattaaataatcagcatgagttagaatatttctttgcaacaaaagatgatcgtgtttatattatggaagaatacgtaaatggtcatgttgaaacttatgatggaatcacagattctaaaaagaatgttttgattgcaaatagtacgattatgttgaattcaattatggataatgttaatgatcattgtgatacagcatttcaaaatcgaattgttgcaggaacagacatcgaagaagtaggtcaaaaagttgttaaagcttttgatactagaagtcgctttttccattttgaatttttcagattagatgctgacaaagaaggtctagggaaaaaaggtgatttagtaggacttgaagtaaatatgcgtgctccaggagcatacatgccagatatgatcaactttagttatgatagtgatgtttatactgtatgggcagatatggttatttatgataaatgttatttagatttgaaacaacaatatctagtagcttatatagggcggcgtgatggcttcagctatctacacgataataatcaattaagaaatcaatttaaaaatgatatcgttttagatgttgatgtacctgaggtattaagtgcagccatgggaaatcatgtatttatggttagaagtgataatcaggaacatcttgattatatgattgatgagtttttaagaagaagcgatggaagtaattggagatagtcataaaaatagtcaatgaaaatataaatttcattgacgagatatagtgagaaaagtattgaaatcattgattttgatacttttttatttaaaagattttcataaatatcttgattgtttatgtcttttgtaatattaaaattgaaaaataaaggattaaaatatgcggggataaaaaaatattagattattaaaaaaaagtcttccattttttgtcaaatatgttataataaaggtggttcagatgatgaaccactttatcccaaatgtgctctcgcacaaaacgaagggagagcgaaagctcttccctccccacaaagttagagcagttctctaactttttattaataaactatatgtattgtatttagatttataattctattatcggtaattttttatgagttgcataggtgacggaataaactgcgatgaaccaatagaaaggtgatcctaacagatcccctttttattttttataaaaaaattagatagtcaatttatttacaaaatatgttattttaataacatattacctctcccgaaccttcgatatatactccatcactcatagcattaacaggtgctatttcaatatagtaattaatatcagttgaaaaacctgaacctagaaatttagttaaatttaaactgattggtgcataaaatgtagcaatattatttgaatgtggccaagcagatctacgtaaattaactgtaaattcaccgctttgaccagatacttcattgccgtttgcataaacatatttagttttataacacgttatttttacacttgttgtattgagtttaaaactttcagaattaacaaaactatgaatcttaaatttaaaactctttgcagtacttcttgtgttattccattggaaatattctccagtttcactgttatagtaattaccaaattcatcataattgctttcagtagtgatattttgagtgtctagttgtaatgctctaacgcttgaacacgaaattataaaagataaaataatagataatgatactgataatatttttctcataatgatttttatcctttcttgcaaaatattgattattaaaggtttactatatggttatgacggttcattctaaattgtaaataaattagataactatctatcacaattttaccatttttgatattatattacagagaaaattaatgaatggtattaaaacatcatcaatggtatgatgatagttttataaatgagataatgggtaaagaaaagactttattaaagtaaaaggagataatttgtatgaaatgggcgattgtagatgatcaaatagaatatctttcaatcataaaaacaataattcaagaattaaagccgtacattgaaatcgatatttatgaatcaggtcaagcctttttaaaatattctgatttatatcaattagtttttttagatattgatatgccggatcttgatggtctaaaggttgctagaatgttacgaagttatgatttaaatattgtttttatcacttcatactctgataaaatgatcgatgcatttggtaaaaatgtcatcggttttgtcttaaaaaatgatttgaaatcaggcttgaaaagaattattaatgagtattatcaggaaataaatgagccgtatcttacaattataaataatcaaatagaagcaattatctatttagatgagatagtatatttaacttataatttacgtgatattacttttcatctattgaatcaggccaatcaaacgatcaaagaaaaaaatcttaaagatattcaaaaagttttggataaccgtttttatcaaataagtcgtaatacgattattaatcttgattatgcaaaagattgttgtcatggcgaggtacgaatatttgatttcaaacttccagtttcaagaaggagatgtacagaattaaagattaaaatattagaaaggaagttattacatgttagaagggattgatatattttattttttaatacagttattgatttttatgtgtttatcgtatctttttttaaagacttttgcttactcaataaataagattaaattattttttattgcaattttcagtacatttatatatttatttttttgttattattttcatagtttatttttatttggatcaattacttttttactcttaacaataatattttacttacaaactcatgataatttattacaaatatcatttaatagttctctaataacgatcatttataacctggtttttgtaattgttagtgttttttatcgatcaaataattctataatagatattaatgacattacagtagtagttttttcctggatcggaaccttaatgatcattagtatattttataattcatgttttggcatatttataattaaatctaaaaatacaatttattattctacttatgcgcttatcatgttattcattgaactctgtagtatcgcaacgatctctagccttaaagacttatctttttatcatattttaaacttatttttgattggaatattatgctttttaggattgattattgttgcaatattaaatactacaacaaagcagttagaagtcactaaacaaaataatctcagtaagacttttttaaaactttattataaaaaaattaaagatgatcaagaatatttaagtaaaatcaggcatgattataataatcagctgatcgttctacaacaattattaatacaaaataacatatccaagtctttagattatatatctttattaacagataaaattttagagaagaaaactaatatttacacaaaaaatgttttgattgatgcttatatcaattatcttattcaaacttactctgattttaattttttaattcgaagcaacgatttatcaattaatgaagatatgagtggcgatttactattagtaattatgaatttaatcaataatgcgattgaaaatagcgatgaaaataaaaatatagtagcagaattattgtttgaaacaaagcagtatattattaaagttgaaaacagctgtcatgaagatccaaatctttataattttaaaactagaaaaaaagatcagttgaatcatggctatggtttagaaattgttaaagatattgtcgctaaatatcatggaacttatttaacggattatcatgataatatttttaaaacttatattgttttatataaggatgaaatgtgaaagttatgtctagatcaatcataaattatatatttgtgttcgattgatgaaggcggaatggaggtttgtatgaaaaaaattattagtcgctggctgctgttaagttatctttttttgctattaagttttatatacatagctagtggacctgctacgccaaaagaatcaacttatctagagaaaattattttttgcagtaatttagttcctttttataaaattggaacagtgaagatgatactaacttcattgattacatattttccaattgggctaatggcccgtgacgctttttcgtatttacaaaaccaccgaaaattttatttatgtttaatattagtgatttttagttttgaactgattcaggttattacattaaaaggattttttgatgttaatgatattatatttggatttattggagcgacactagtttatttattaagcgaaagaatcattcttttatttaggcggttaatagatattgagttataaaaatgtatatatcaactatagtataaattgtaatttagtgtattttttagtagcaagaacctagtttaggttctttttgttttaaatgtaaattaaatatttgttattaaaaaaaatagttaaatttatttgataaaaagggcgaaaaataaaatgaaatgtagttaaatatagatataggagggcacaaatatggaaatgataaagttaaaatttagtttaaaacaaattacactaatgattcattttcaagatgatgatggagcaacaatcagagctacagaattaaaacccaagcttgatcgttttattttatcatggcttgcttatgaaaaagaggtgaaaaagcatcctgaacaaaaattaggttcagaaactgaaatgttaaaaaatgttgtagataatctggtgaataaaaagtggttgattgacaaggaacatatcgcattgaactataaaatgagaataatggcagaaaacaaagtcaatatgaaggtcaaatatggtaatgctgtttatgttttaaataacaaaaaatatagttcttctttctaccaaaaaattgaaattaatataacatgttttaatcaacaactagcaaataaaattaaagagttaatgccaattttgattgatgtaacagcatttggtctacaacaaggcaagggatatggaaattttagagtttctaagatagatgatcaggaatataaaaatagtatcgaagaaaatttacttaaagtagcaaatcattttaaggataataatgttttagtatataaacttgaattggataaagaaaaaaacggtaaaattgatgctgattatgcggttgctttgaatgcaattgcagaatataatcgtattctcaaaagtggtcttcactctaattatgaatatgttccttcagtaatcatgaagaagtattttaaacaagatggttataatattgttaatgagaaaaaagctatgaaacaagggcttcatttagcaaaatataatattgacaatttaatgtatcatgataatgaaaaaactattaataattatagtagatcatcaaataaagtatattatacaagagggttattagggtttgcacaattgtatcaatttagtttggaaactaaagaaaatcgtaataaatttaataaaattcctcgtaaaaatggaaaagaaacaatgagtttttggaaaagttttgatgttaaagcaaaagtgggaaaagatgaaatatcaagatttccttcaccgcttcattatcatgtcacagaaagctataaagaaatatatattatagtaaataataatgctttaataagtttacaaaatgctgatccaaaaataagttttagagaaagaaaatataaaggagaaaaaattgatcgaaacaaaataaatattgaggctagattgcctaatcaaaaagactttaattttatcgatttttttgagatagcaggattaaataaggttttatatatggtggatgttaaaaataaattcaacgacaactatgaaggtgaatactttttaactagattggaggaaagccaaaatgaaagataatgaaatgtattatgggataacgattggaccgatagttaaaacattatgtatgacttcaacaccaggaggattgtgggttgccagctatatattttcatatcttgctaaacaattaattctagaaataaaacaaaatgatggtgatgtattaatacctagttttgaagataagaataatgttagtgaagaagtaggttcttatcctgaccatattatttttattgctgatgaaaatctagatatcaataggatgataaagaggattaaaagaagaatgggtaatttattattcaaaacatttattggaatagatagcgataaatttcctaaaagatattttagtagagatgaggttaaaaccttcgttaatagatatgtaaatattcattgtatcaagacaaagaagattaataatattatgcttgaaatcagtgagatattagataatgttgaacagttcaattcttatgtgtatgaagaaaaagaaaattatttcttaactttatttaatggcataaaaattaaagaaagtgatcagcttgatgataaagataaaacagatgctaaaaatatttatatcaaaaacttttttaaaactataaatgatgataaaagaaataatacccaaatcaaaccacaggttctgtttgaaaaaaatgataatcaaatcaaatccgtagatgatatcgccagaataaaagataaaaaagattataaaatatctaactatcttgcaatagtacaggcagatggtgatggaatgacaaacaaatttaatgatatgggtaatgatactgaaaaagttaaaaaattttctaaaagttgtgttgattatacgactaaatcagctgctttgatcaaaaaatatggtggtgtaacgatatatgctggtggtgatgatttattgtttttagcacctataataagtaaagatggtaatgaaaatattttagatctatgtgacaaaattagagttaattttaaaaaatcaaaaatcgaaggagctagcatatcatttggaattgcaatcaattatagaaagtttcctttatatgaatcgtttgatcaggctagagaaatgttagataaagcaaaaaaactaggcgatgataataagaaaaaagacggcatagcaattaatttaactaaagcgagtgggttatcagtgtttttaaattttggtaatgaaacagaaactttaaagaaatttaaaaatcttataaataactattatctttctaataaagagtctgaaaaaataaacgacagtacgaattctgtaatctatttgatggataattatcgtgatttatataatattgcaataaaaaataaggataaaaaagaaataagcaatttctttactaatatgtatagtaatccgatgcaggataactatcaaaaatttattgaagatattgcagatttgtttattcaagctaaaagtgataatgagagtaatcgctttaaatccataaataaaaatgattttaataaagacgaagatactgaattatcaagtatgttaagatttgctaaatttttagttgaaaaaggaggcaagagtaatgagtaagtattgtgtagaattagagccgattgaatattatttcctgggaaatgaaagaagttttggatttggtaggaataataagggaatttacaataactattttgtaatatcagaaaatttaccgacacaaacaacattattagggatgatgagatattttgtgttaaaaagaatgaatttgttaaataagaattttagtagtcagggattaactgctcaacaaattgaaaagcaaaaagaatttattggtagaagtagttttataatgtcatgtaatgataaattagaatatggagttattaaaaagattagtccaatgtttttaaaaaataataaaaaacagatattagttaaaaccccttttaatggtagttttgataataataaaattaaattaagaggattgcaagaagatgtttgtaaaataatggatggaagtagtgaaagagattttaaattgattgataaaatagatttaaaaaaagaagatgattatcgtgattcatatgtacttttagatgatttaagtgttattgaaaatagtgaaatttttaaatcacatgtaaaagtaggaattaatcgttatttagatgaagatggtttctttaaaaaagagtataagttttttaaagattataagttatgtttttatgtaacacttgatgatacaaagttaaatttggatgacaagataacagatgttgtttatctaggtgcagagaaatcagcatttaaattaactatgtataaagaaaatgataatttagaagaaacgataaaaaagactttaaagatcgatgatggtgtttattactatgctttatcggatttagcttgtgaagatgctaataaattaaatgaatgctgtgatctgatttttttggaaacaagaaattttagatgtttaaaaactaattatgataaagataatttttatcataagctagagcaaagtgaattatataattttattcgtgctggtagtgttttctttgtaaatgaagcaagagagcaagattttgagcatttatttgaaaatgaaaatttaaaaaatatcggatttaatcagatcataaaaataggaggaaataactaatgaaaagtattatatacatactagaaccaattactaacctacatgtaggtaacggagatattaattataatattattgataatgaggttgaaaaagacccgcttactaattatccaatgattaattcatcaggaataaaaggggcttttagacaatttatacaagataattctaaaattaataaacaagatgaaatagatatttttggttccgaaccaattgaacaaaacaaagatgaaaaaaagaagccaggtaaactaaaattttatagtggtgaatgtttaggggtgacaatgcgtaatgaagtcggtaaggtgccatattcattggttactactaaaaaaatgttagaaagatttattgaaatgtgtgaggttatgaaaataaaatacaatttagatgtagataagttggatgaaaataaatcttataaagttgctaatggtaatattaccgtagaagaaataaaaatcgatgataatttaaaagatgacgaaatcaaaaaattatttaagcagattgctcctgatacagcaaataatcttgttattatgccacatgataaaataaaagatatttcattaccagttgtcgcaagaaatgttttagataacggtatttctgaaaatatctggtatgaagaatatgttccgcatcattcccttttctttgtttgtgttagctgtgaagaagatgaagtacttaaaaaatttaatgaagctgttaataataaaattgtccagtttggtggtaatgcttcaattggttatggacttactaaagtaactgtatttaaagaaggcggtgatgatgatgtcaaagagtagaataaatagatatttaccgattgcatatgaagcagtaaaaaattctgaactcattaaagataataaattacaaggaaattatcaagcacaaatcgcttcttttggagcagctgttagcatgggaagtttgttatcagctattgctttttttagtgataatggtagttctaatgtaaagcgtcaagaattaatgaaattgatttgttatattataaaaaaagataaaaatagtgaaaaagaatatcaggaaataaaaaaatatgatttatttgaatgtgtacagaataataaaattgtaaagcaggaggtattagatgctgctattgcaattaagctgactcttaatctgtttgaagaagatccatcaaagaataaaactcctaaaaatgaagggaatgattaaaatgacgatttcaaacatgaactattttttcaataaatcatattatgattttttaaaaaatatagctattgatgataaagaagaaaaaataatcgaaaacaatatgataacaacgataataagtaaaaataatgacgatatagtaaagcatcgttatcgagaagatagatttttacaaccccttcaagatatactttcgtcatttgaaatgaaagttgaatatcctggtttattaattggaatcggtaataatcataaagctaatatcaaaggagaaatatcattaggatttaattttgattacgtaactggtttaccatatattcctggctcttcattaaaaggtaaacttgccagcgctttcggttatcataagtatattttagctaaattaaatattaaagatattaatgataatgaaaaagaagaatttgtaaagaaaataaaaacagctatttttggtgatgaaaatacaccagggaaggacatctttattgattcgtttattagcgattataataataagaatgttctaaaattagattatttggcaccacatcatcaaaaagaaaaacttttaactttaggtgaagttaatgttattactatgttacgacttgcacctggtactaaaataaaatttaattttattttaaacgattctataataaaaataggtgataaagaaaaaactattacaaaggctgataaaatatatttatttaaagaaattatgaaagattttggtattggggctaaaacaaatgtagggtatggatattttatagagtagggctgcagggaaagtacaatgaaagaattaaagattattttaaatgaaaatgaaaataagatatctgcaaaagcatgtatcaaaaatgatgatgcagataaatggcttgagggtagtgaaagaattgaaaagattaatgaaatatataatgctgaagaattatatgaattattaaaaaataatgaaaatattataattaataactcaagtttatttaaggaatttatagaattaaaaaaatcagaattaagatctaatatctgttctttagaaaaattgaaagttgatagtgaatttaagaaaaatagactatctaaatataagggaatttttagatatttaaatgaatatgatgttgaaaaaattattgaagatgataaaacagttattgagaagaacaaagtagtatatagttatcatacatttatttttccatttagattgataaaaaaagaaaagagcaaaaagaataaatcatattttaaggaatatgaaacaaaaaaatttttaaataatattttaagagataatgatgcttgggttaatgctaatgtgaatgataaatgtcttgattcttataatgattataaggaaatatttacaactaaagcagaatttgaacaattttataataagatgcaatattttaatcgttcttgtttagatgctatttatggatttgaattaaatgatagtgaaaaagataatttaagaatagtagataactatgtatttaaacctgaaaaaattagaaataaagcaaaattacatattcaagtaggaaaaggaagtagcgtacaggaatatactttgttattaaatgcaattcgattaaaagtatttaatactaatattgcagtaatggtattagaaacagaaaatcatgaatatgataagattgaagatattaaattgattaatgaatttacacgtcgagttactcctcctaatttaactgaatcaagtaatccatgtgctttttattgggcaatagaatttgatgatggaaatgagaggcatactactgaagaaaatttttataaactatttgaaaatacaagatctaaaaaaaatgtaatgaaaatcagtcttacaaaaattcttgatccgattaaagatttgttgacttatccaagcaaacatgatgaaggtgataaaaaaatcacatctaataaaaagaatctaatagatgaaaacacatatttaatagaatcagttcttggtgatcgaatgtttacatgttcctttatcaaatctgatgaaataattaataaaatatcaaaaaaagtttatgactctcgatatccatgtcctgaaaataaattatttatgaggtatgcgggagaaacgaaatatgcttatcaagttgattatgatatagctaaagagttatatgctctaatatatatagattctagtgatagtacatgtcagtcagaagatatgattcaagagttattagcaaaaagtttatatacacgctggattgattatggaacaattcatgctgtaactcatcattcattaattggattagctagctttagctgtcctgatcatgtaattaatgcatttttaacattatatgttgaaatggctatattggtgcaggcacaacgagcttcgataattctatttcaaaactttgcaactgtacttacaaaaggtctagaaagtgataataaaaaaattgatcaaaaaacaattaataatttattaaatttacaagaaaaatatatttcttttcaaaaccaattattattttttgaagtaacaccagaagagcagggcgtagagatctacaatatgcttacaaaagcaatgtatatcgatgaagaaaaaagagaattaaaagaacaattagatggtttatatacaggaactaacgctaatcaggataacaagtttaataagtatgctttgatttttgcagttatctcattgttaatagttatttttacatatggttatgatacagtttcaattgattatgattttaatggattaattactaagatatttaaaaatgaaaatattttactaattatttgtaagtatagttttacatttataatgattatcttaacggcttttattagttggggtatgtattgttggattaaacgaaaatatgataggtaacatgttaaaagaaatattgagtgaaagtaatctaaaaaaagcttatttagagttaatgaagcgtaactattctagtgggatagatggagtaatgttatcgcagttaaaagaatatttgattcttaattggcaagatattgaaaatcagcttgttttaggtacatatgaacctaatattgttcaagtatatgagttactttctaaaaaaggaaaagtaagagaaatatataaatttacgattattgataattttattcaaaaagcagtgtctttaatattacaagataaattagattgtttattaagtgataataattatagttttcgtaaaggaaaaggaacgatagatgtaattagaaagggattagaattaattgaggaaggttatgaatatattgttgaaatagatataaaaaagtattttgaaaatattgatcatgatttattatcaaagatgttatttgatattattgatgataaagttttaatatctttaatcatgaaatatcaaaattgtctaattcaaaaagatggaaaaatcaaaagaaaaaataaaggattaattacaggttcttcaataagtcctgtaattagtaacctttatttaatggatttagatagacaatatcttgaatataactatattcgttactgtgataatatttatatatttattaataataaagatgatggtataactttaataaatgatatatcaaaatgcttaaaagacaaatataaattagaaataaatcaaaataaaacttcaatcactcattatttatcaaaaagaatgttaggctattattttgttaaagaagataatactgttaaagcaaagaaaaataaacaagaaaatagaactaaatataatcgctggtataaatcagctatcaaaaaagaaaataacgaataccatattatcaatgatggtattcttaccaaaaaagattattcaatcttatttgaaaacgaaaataaaaaaatagaaattccagctgaagtaaccgaacacatcaatatatattcacaaactattttttctagtaactttttcaaaactttaaatcaacataatataagagtttcattatttgatcaatatgatcattatattggatcttttatacctattaattatcataaatcagcctcaatactaataaaacaagttgaaaactatatcaataaagcaaaaagactagaaatagctaaaaaaattatcgatagtggaactacaaacattatctcaaacctaaaatactataataagcataatgatgatattcaattagataaaataattgatgatttaaaaatatgtaaacaagaaatgaaagcagctaaaacattagaaatattattactacaagaagccagaatgagagaattatattatagtagttataatataattctaagtaactcagaattcaaattcactaaaagaacaagaagaccccctaaagacgcacttaatgcaatgatcagttttggtaataccataatatatcaaaaaatagctaatgaaatatataaaacaaaactagatattagaatttcttatttacattcagcaatgcgtagatatgaaaatctaaatcttgatatctcagaaataattaaacctattcttgttgataaagtaatattttcattaataaataaaagaatcattgatgctaaggttcatttcgaaaaaagaaataatggagtatttcttaataaagaaggtaaatatctttttattgatcagttaaataaaaaactaagcagtacaataacgatcaataacaaaaaagtaagttaccaggaaatactacagcaggaagtattaaaactattaaggtattttaaatacgatgaagaatatgaaccctttaaatataggatgtaactattatgtatattattgcagtatatgatgttcatcataaaagagtaggtaaagtgagaaaagtatttaagaagtatttgtttgcagttcaaaactcagtgtttgaaggttatattacagaaagtaaactaaataagttaaaaaaagatttagataaaataattgatgttagttatgatagtatctgtttctatgaattagagtcgttaaaatatgtttctaaagaacagattggaatggtaaaaaaccattccaatctaatatgaaaaggagtaatatgagatataaattattttttaaattaaacaagcccctaaaattaagactaaattatcacgaagatatccaaagattcatttatcttctatttactaaagaaaataaagaatacgctgaatttctgcataactttggttatggagaaacaaagaaatataaattatttacatatagtaaactatactcacctaaacaaacaataaaaaatcatgaaataatattcgaaaacactctcatcttagatatcgccagtatagataccaaattcgatcattatcttttaaacattctaaataaacatactaattacaaacttcaaaatcaaaacataattttaaccaaatatcaagtatttctctacaacaataaagaacaaataaaaataaaactattatcaccaatagtagtaagagaaacaattcttgaagaaaacaaaaaacatacccactatttcaatcccctagaaaaagactttttagacagaataaataacctatttaaaaagaaatacaaagcatactatggaataattccagatgatatcaaaatcaaattaataaatgttaatgcaaaagataaatatgtaactaattataaaaatacatatataactgcttggcatggtaactatatgttgcagggaaaaaaagaatatttagaatttttatattatgttggtttaggagaaaaaacatcccagggatttggcatgtttgaagttatagagtaaatattttgcggtcaatctaaaccctatatccatcaagacttttgagcaattttataatcataaaataactaaaaatcatcaaaaataaacaaaaaacacagtcaatcttttcaagatgttcattaaaaacacaaaaaatgctcaaaccctatgatacacaacacttacacacaaataattaattttgagattgaccgcaaaaaacactcataaaatgtttaaaaatagttaaatttatagtaagatataagaaatagctagtaaatatagttgttgtaccttatctaatgaggaattgttacttaaattacttttgttgtactcaataaccattggcaacagttgtaccttatctaatgaggaattgttacttagctttctttgtctaagaaaggatagtatccctttattcgaagttgtaccttatctaatgaggaattgttactaaaacttggtatacactaggcttctatcacctagtatgttgtaccttatctaatgaggaattgttaccaatagatatcctttacaatttcatgaccaacagcacttttccgtacaatagttgtaccttatctaatgaggaattgttacgcaaattctttaacaccatgcaatatcttcggaaagttgtaccttatctaatgaggaattgttacataattctcaaatctttttggaggaattatcccctccagttgtaccttatctaatgaggaattgttactgttttctgcttcatacattgcgattttttcatcaatgttgtaccttatctaatgaggaattgttacttattatgcataatgataaccttatcttcaaaaaatatagttgcaccttatctaatgaggaatcatatatatgatcattggattgtataaaaatagagttataaattttaagagttgtagttagttatgtaattaggtattaaattatttatagttaatgtattagatagtcaaaagggtctctaaatttccgtggggttttaaaaaatgagactctaaaataaagtggggttttggtgaccccacttctgtttatagttgaaaaagtatcattcaataccgtggggtcaagaatgatacttttaatatgccgaaacaaccattttatttaattattatctgttttttaaagtttttgtgacagtctttacatataaatcttctacatctgtaattgatgacggttttattagtgttgaaaatagaatgagtaattttctttgatttatagtctttaacattagcattcaaactactgcaacaggggcaggatttaatctttttagttaaagtaatattaatgtttataatatcgtgagatctaacaatattgatatcttgaatatcgtcaggttgtaaacccaataaatttatagtatcataatccatgagataacactctcctttcaaatatggttgtatctgcaaaaacaatcatatcatgaaaggattttttcatactataagagtaccccacgaaagtttaaagtacaaaaaaagccgaccccatgaaactttatacctaggggtcgaccccacactaatttagatatcgagtcaaaatatgttgactatttttttgtgttttataattattaaatgatttttaatgacatatttgtgtaaatttctcaaaaaaattgttataaaataataaatatgctatattggaggtgtaggatggtgagttttatgcttgtgcaatttacagtaaaaaattttatgtcatttaagaatgaaaatattttagattggagtgcagttaatgcttataaagaacatagtgataatttaatttttgttccaaataaagaaaagtttttaaaggttatgtcaatatatggtgctaatgcaagtggtaaaagtaatatattgatggcatttagattttttcggaaaattattagggattcttttagtaatgcaaataatgaatcttttgaagaaataaatagtaatggtgttttgaaaaagtattatcagccatatgctttttgcaaagaaaaagaagatacagagtttgaattaatttttattattggtgataaggagtatcaatatggatattgttataatgatcaatgcataaattatgaatggttatatcaaacatcattagaaactaatcgaaaaaagataatttttgaaagaagtagtgataatattgaattaggttcgtcaataaaaaaagagtgtcataaatatataaatgaaattgataatgatgttttagtgttatctttttttaatcgacttaaattaaaaaataagttatttaatgatgtttataatagcattattaaagttcttgttttttgtgatgagtttgatgatttgtattcttatttattagaagatgttttgattacatttattgataatgaaaaagataatttattacaatatttagaagcaattgaatctggaataagtgatattaaatataggaaagataaagataaagtaagtatttatacttatcataggggattagataataatgaatataaactagatatagataatgaatctgctggtactgttaaaagtttagctttatatgctttaattaaagtagtaatagctagtggacaagctcttttttttgatgaattaaatattaaactgcatccattgttgcttaagtttattattgatatgtttaataacagtagtactggtgcgcagttgatatatactacacatgatgttactttattgagtaataaattttttagaagagatcaaatatggtttactcaaaaagatcaatatggtatatcaaaattgtattctttagctgaatttaaaataagaaatgatgcgtcttttgaaaaagattatttgggtggtgtttatggaggaataccgtatttaaaggattttgaaatagggagtgaagataatggggaaggatgatatatttaagaaaaagagagccgaaagacgaaaaagaaaatttgaaaataggcagccgcatgctcattcttatttgataatttgtgaaggtaaggaaactgaaccaaattattttaatggtttaaatacaaaaattcagaaaaaaataggtggtcaaattaaaatagaatctatcccaattattgatgttattggtgaaggtcaaaatacaacatcattagtaaatattgttgaaaaaagagttaaggaagcaaaaataatatatgagaatatatggatagtatttgataaagatgattttgaacaatttgataaagcaatcaatgaagctgaatcaaaggaatataaggtagcatggagtaatgaatgttttgaattatggctattattacatttttgttatatagatagtgcactttcacggaaggtattatttcaaaaaatgacagaaatatataatgattatggatataatcataattatcaaaaaaatgatccaaatatttataaattttgtagtgaagttggaagtgttaaaaatgctataggaaattctaaaagacttatgagtaattataaaccaagtctttctccctcaaaatgttctccagggaacactgtgtatcaactggttgaagaattaataggttatttaaattaaaggaattagcaaatacttattttattaaaaataacaaacgagagtgcgtatattatttagtaatgagtttagagtaatattttgtggtcaatctaaatcctatatccatcaagacttttgagcaattttataattaaaaataactaaaaatcatcaaaaataaacaaaaaatacagtcaatcttttaaagatgttcattaaaaacacaaaaaatgctcaaaccctatgatacacaacacttatacataaataagtaatttagagattgaccgcaaaaaacactcataaaatgtttaaaaatagttaaatttatagtaagatataagaaatagctagtaaatatagttgttgcaccttatctaatgaggaattgttacaaattaagcaggaataagttcctgctttttattttaagttgcaccttatctaatgaggaattgttacgattacaaggtattattctaaacttttcatccaagttgttgcaccttatctaatgaggaattgttaccataatgttttcgtactcacttaagaacgggatacgcccgttgcaccttatctaatgaggaattgtaacttttttcaaatcttttttcagcaaatggtaaagctctgttgcaccttatctaatgaggaattgttaccagcataatctgtttttgtttttcaatgtttctgtatgttgtaccttatctaatgaggaattgttactatttgttttcatgatctgctcctttctttcaaaaagttgcaccttatctaatgaggaattgttacttttgccataggaaggatttcttttcctttataggaaaaggttgcaccttatctaatgaggaattgttacgaatagtttttgaacagtaacgttatcaatatggttagtgccaaaagttgtaccttatctaatgaggaattaacaagttattcatttaaagaattagtgataattgttttatttaaaataatgtagtaagataaaagagcgtatatacgctcttttgttgtggaggatggaaatggagttaaaagtagtaatatttgatatggatgggttgatgtttgatactgaaccgattggggcaaagtgttttaaaacagcagctaaaaagtatggttatatagttgatgatgaatttcagatgggattgatagggatgaatgttcatgatcatgttcttaaagttagggctaagtttggtgatgattatccagtatttgagatcagagatttagcaaagaagttaaaaatggagtatttttatgaatatggcttaccgatcaaaaagggtttgaaagagctggtagcttatttaaaagaaatgggaattaaaattgcggtggcttcgtcatcgtcaattgatttgatcaatgagtatttagagttatcaaagatggaaaatgagtttgattttgtgattggcggtgatgcggtgcttcatggtaaacctaacccagaattgtttttaagagtattaaaacattttaatattagtaatgatgaggcattagtattagaggattcttgtaatggtattatggctagccataatgcaggaataccagttatttgtgtaccggatctcgttgttaatggaccggaaattttagcccttacatataaaactttaccgtctttatttgaagttaaagatgagattgcaagtattttaggagataataaatgataggaacgattgtaaatacagctgcggttattattggcgcaagtattggcttattgataaaaaaggggattcctaaacgagttggcgatgcgttgatgaaagcattaggattatgtacgctttttattgggattagtggtgcttttaaaggtgaagatacgctagtgatgattatttccatggttttaggaactttgatcggtgaggctgttgatattgataaacatgttaatagtggggttagaaagattgaaaaccggtttacaaagaaaaatagtgagaatagtatttctcagggctttattacagctagtttattgttttgtattggttcaatgacgatcgtaggggccatgaatgccggtcttttaggtgataatacaatgttatttactaaatcgactttagatttttgttcatctatcatttttgcttcgactttaggaatcggggtattgttgtcagcgggatttgttttagtctatcaagggggattgacgcttttagcgatagctgctgcgcccctgttaagtacgactgtaattaatgagatgacttgtgtgggatctttagttattatcgcaacaggacttaatttattagggattacgaaattaaaattgatgaattatttaccggcgatgtttttaccgatcattttatgtttatttatgtaatttgttaaagaaatgttatttttaggataacatttttttctttgttttaagattaagttaaaataattaagtgttagtaaagtctattgtttgctggatttttgagtgctaagatgtgcctgtaaaaattttacaaggagaaatggaaatgaaaaaacaaaagaataaagcattaaaagtttcaatggcaactttagcattattaatgggtaccggttatgtagccaacaattaccaggtattacctacatatgctgatactgtaaaaacaactgaagcagttaatttgatcaatgcttcaacaacatggaaatatttagataacaatgttgatcctggtagcactacagatcgcactgcctggactaaagctgattatcaagatgctgactggaaaagtgcggctggtaaatttggtgctaaaaatggtcaattagctagtttaggtggtaactttacaccaacagtattgttaaatcaatatattgaaggtactaatgacgacattccagcattcttttttagaacaacagtaaatattgatagtttagataatctatcttcaattactggtaatctttattacgatgatgcagctatcgtttatatcaatggggtaaaagtagccgcatttgatgaaccagctggtggttttgattcaaatatgtcttatgggggttctaatgccagcacaccaaaaacaggtgaaatcaatctaactaaagaacaattaacagctgttttaaaaactggtgaaaatgttattgctgtagaacttcatcagggaagatccagcagttctgatatgtatttagaatttgctaatttacaaatgaattatggggaaccagaagtagaagttgaacaaaaagctcttaacttaacagttggtgaaaacgaatcagaaatgaatcttacctggtatgcaaatattagtgaagctggagtggttcaattagctaaagctggagcgatgatcaatggtgaattcccaagtgagtttgtttcaatcaatgctactagtgatcaatcaaatgataatggtttctactacaatcaggcaactataacaaatctagaagaaaatactaaatatgtatatcgtatcgtaaatggtgataaagtaagtcaaatttatgattttacaacaaaggattttgatggaagttataactttgtctttgccggagatccccaaattggtgctagtggaaatgaagcaagtgatactgaaggttggggtaaaacgttagaagattctgttgataaattcaatccaaacttcattttatcagctggtgaccaggtaaatacagctagcagcgagtctcaatatagtggttatttagaacatgaagaacttaccaatgttcctcaggcaacaactattggtaaccatgattcaagttcaaatgcttactcacaacatttcaatttgccaaatgttagtgataaaggtgctactactgctggaagtgattattggtatgtttacaataatactttattcatggatattaataccaataatatgtcaacagctcaacataaagcatttatggaagaagcaatcaatgctaatccaaatgttcgttggaaaatcgtggtcttccaccattcagtatattcagtagctagtcatgcggttgaaagtgatattttacaacgtcgtgaagaattaacaccagtatttgatgatttaggaattgatgttgttttaatgggacatgaccatgtttatgttcgcagtaatatcatgaaaggaatgcaggtagttactgatacaagtaaccttgatagtgtaactgatcctgatggtatcttatatgtaaccgcaaattcagcttcaggaagtaagtattataatattaaaactaatattagtacagaattcgtggctaagatggatcaatctaaacaacgttcgatttcaaatattgaagtaagtgatgatcaatttaaagtaacaacttatttatatgatgctaatagtgataattgggcaacattagatacttttacaattaataaaactgttgcaacagcagctgataaagcgttcttgaaaattgctattgaagaagctgataagatcagtcaaactgatatcgatgctttagttcccgtagtagcaaatgaatttatggcagctcttgctaatgctaaagatgtttataatgatcctaatgctactcaagaacaagtcgatgatgccggaacacgtttggcttacatcatgcatttcctagatttcaaaaaaggtgataaagaagctttacaaaaaatagtaacaacgatcgagggattagatgaaactaaatatacgtcaactacttggcaggcaatgttaccagcttgcgaaaaagcaaaagaagtgttagctgatgaaaatgcaatgcaggatgaaattacaaaaacgcaagaagctttagtaagagcatacattgatttaagattgatccctaataaagatcttttgaatgatttaattaaacaagctgaaagtttaaaacgcgaaaattatagtgaagcaagctggaacctattacaaaataccataaattcagcacgtgaagttttagaaaatgaaaatgcaaccgaagaacaagttactgatgctcaaacaacattaagtaaagttcttgaaagtatggtaatgaatgaaactaataaagttgaaaacacaacgacaaaaccagcaacaagtacatctgttaaaaaaggtgataaagtagctaccggtgataataatgatctattagcttatggaacattgctatttacagctttaggatgttcagtgattgcatttaaatcaagaaaaaataatcaagagaattagacagatatagtggtaatgatattaccactatatttttagaggtaatacatggaaaagtttattaaggaattgaaagaaaataaaattgtaataatagttattttattgacgatgatagtctcattattatttaataattatttaaaaaaagattattcaagagttaataatgatactactgattttgttaagggagaagttgttgaagtgactagcagtagtatcgaatacgatgaagagttaaaaattaatcttggtaagcaggttgttaaagttgaaatcttagcaggaaaaaacaaaggaaagacggtgacgatggataactatttaacggctactcacaacattgaagttaaagtgggaactaaagttattatttcggctgatgaaccagatggaattgatgcgtattatacggtttataattttgatcgtagtttaggaatgatcatatttacattgatcttatttatggccgttattacgataggtaaaggaaaaggggtaaaatcaattattggtttagcttatactttatatttagttatcttctttttattaccaacggtattttctggttatccgcccgtatttatgagtgtgatttgtgtgattctttcaacgatcgtaactttaatgttgttgaatggtagatctaaaaaaacttatggagcaataatttcaacgatcttaggcgttgttttaagtgcaggatgtttttatttgatgtcgcttattttaagtattaatggttttagtagtaatgaagctgaaagtttggtcttgattacaagagcgactaatttacagatcaaagaaatattatttgcgggaattttaatttcttcattaggagcaatcatggatgttgggatgtcaattgtttcatcgttatacgaggtatatcatcatcagcctaatttaacgcgaaaagagttgtttaattcggggattgaaattggtaaggatatgatcggaacaatgactaatacattgattttggcttttacgggaagtgcttttatatcgttattagtgttattttcatataatgtcgatactttacagctattgaattctaattatattgcaattgaatttgctcaaggaattgcggggactttaggaatcgttttaacagtaccgattgcttcctttattgcaacgatgatcttgattaaaaataatgaggatgaagagttactgattgattaagtatagaattttttattcctattaataatctttttatctttctcaatataaaaattatctcaaataaattaattaattgcttatttttgtaaaaaaaagttacaaatttactaccttatttaaagatatgtctcatgataaaattgatatatcaggaagatcagattaaaaatataaaggaggatacgatgaaaaaatttaaaaaactagcaattattgctttagtcgtgacaatgattactagctatattccggttatggcaaaggaaagtacagatgacgaagattacactcaatatgttgatccttttgtgggaactgatgtcgactatggacaacaatttcctggtagtgttgttccttatgggttagtaaaacttagtccggatacttatccccatactaatgatgatcatgcgggatatgactatagtaaaaacagaattgccggattttcacatactcgagttgaaggcgtaggtggacaaggtgctggtggtgatgttttaattacaccgacttatgtaaattatacaagacgtcctgaagcgagcagtaaagcaatgttgtactcacatgatcaagaaagtgcaacaccaggatattatgaagtagaattaacacctaaaacaggtagtgatgaaaacgctgttgataatgaaagcttaggaaaaattaaagcagaaatgacaagtgcaattagaacgggctttcatcaatacacttttcctgaagatggcagtgtatcactattagttgatttgaactatacatatcacggcacagatattcgtaatgcagtgatggaaattgatgattctaatgatgattttactgcaataagtggtcgttttagtggaaaaaatgttagtggtcatggaaaatatacactatatttttatttagaaacgcaacaaaaagtaagttcatttaaaacatggaatggtagtcggctttatgataaagatagtcaaactggaaatgatctaggtgtcattttgaattttgatgctaaaagtaacgaaccagttagaatcaaagttagtctttcaactgtaagcagtgaacaggctaaaattgatatgcataatgagataccagattgggattttgatcaagttaaagctgatgctaaagatgcttggaatgatgtattaggaaaaatcaaaatcgaaaactcagctcaaagtgatcctgatggttcattgaaaaaattattttatacccatttatatcggatgtttatgacaccagtaaatgcgacaagtacaagtaatacttatcgggctactgatggtaaagtttatgaggctaatgattatgtccattatgattcatggacattatgggatgattttagaaaatatccaatgatcggtctagtagtaccagatgtttataaagacattattcgttctttagctgatactatgactacaggaatcggaacttggggaatcgatagtcaaacagtcccaacagtaagaacggaacatgcggtagctttattagctgatggggcagctaagggatacattgattatgaaaatttattaccagcttatcaaaaagccaaagaaattgctgatgcaacagttaacagcgaagttgaggctttaggatatgtacctggtagagtagataaaacagttgaattttcttatgatgattgggctattgctttattggcaaaacaattaggtaaagaagatgattatcaaaagtatttaaaaagatcatttaattatttaaatttatatcgtgaaaacgctgttggtgatatgggtattttatggcctaaagatgcaaatggcaattggatgagcgctgatcctgaacgttatggtgataatggtttgtatcaaggaactttatggcaatatacctggtgggattctaatgatgtaaatggtttgatgaatgcgatgggtggtaaagagaatgctttaacagctctatcatatttatttggggaacaagatccaaataatggtaaagctatgttacatactaatacgaatgaaattgatttacataccccttatttatttaactatgctggtaaacctagtaagacccaatattggatcagacaaatatatactaaggaaacatggaatcgttatagtggtacgggcgaatataatccaccacgttatgaaaaagtatataaattagatcctcaaggattaatggaaacaatggatgatgatgcaggtactatggcatcaatgtttgttggagcagcaatgggcttattcccattaacgccaggtgatacaacatatcaaattggaacacctttctttgaaaaaatgactcttgatgttggaaatggtaaaacatttacgatagaagctaataatgtatctagtgataatttttatattcaatcagcaactttaaacggtcaagaatttaatcaaacatggttagattattcacagatcattagagggggaacattaagttttaatatgtccaatacaccatcatcatggggtgaagatagtgctgctgcattttcaagcagtgattatgtagatacatctatttatagtgatgataatattagtttttctacgaagacatttaatgaaagtgaagctaatgatggaacgatcagtgatgtaataaatgttaatgttaaaaatacaacttttaattcaattgatgaaacaatgatcactgcccaaaatattcctagtggtttaacgttgaaaactgagctggtagatgaacataatttaacattatcattagaaggtaaagcagataaacatgatatattagctagtattgataatttacaagtaacatttagtgatcagttatttgctgaagcaatcgatagtaataataaaactgttaatttaagagttaattttgaagatccaatgttgacatatagccaaagttctttaccagaaaatgaagctaatgatggaagtatcaatggtgaagtggtgattgatctaactggagatatgtttactggggataatggagaagactttgtaagcagtaaaaaagttgtttttgctaatgttcctgaaggtttaacacctcaagtaattaaagttagcgatactaaagtaaaattatcatttactggtaaggcattaagccatgatcaaaaagttagtgatattaaaataagtttccaggataatgcttttgtaagtggaaatgctaatatgataacaaatagttcatatggcggtttacaagctttagtacttgattttataactgactggaaattaaaattagctaatttgattgaccaggctaatggatatcatgaagatgattatacaaagacaagttatcaaaaattaaagactgaaataactaatgctgctagtttattagaaactggtgataatcaagaattacaaacagcatatttgaatttaagtaatgcaatctatgatttaaaaacttcacaagatggttttaatcaattagaaggcgaatcaagtgatcttaattctggtaatggattgaaaaatgaaagtatgaatctagggggaacttatgataatgcctggatagcatatgaaaaactagactttacaaaacaggatgtaagtagttttacaattcgttatgtcaataatagtactcgttgtgcaagtgatgctcgaattgaaatccatacagatagttatgatggtccactagtgcagacgatcgatttaccagcaactggttctagctggaatgattatcaagaaataacaacaatgatcgaagatgctagtaaattaaatggggaaattcatgatgtatattttgtattgaaaggaacgacatcttcaagtaacccatatattattaatttagattatgtaagatttaatagtgaattgattttaaatgctaatgaacgaatcgaagctgaagaatttaatgataaatcttcaggaatcgttaatgacggttcgaatattggtggtgttactaataattcttggacagcatataaaaatattaaatttgatggtagtgaaaatacttttgaaatcagatatgctggtcaaataaaagatacatttaaagatgctaaagttaatgtttatcttgatagcatggatagtaccccagttacaacaattactgttcctccaacgggaacaaactggagtcgttatgtaactaattcaattaagttagatagtagtattgaaggaattcatacagtttatttgcaatttgttggtagtgaagctaataaaacatatgttgccaatgttgattattttagatttgtaaaagctttagaattaaatgttgtcagtgaaggtaatggttttgttagtgttccggcacctgttgctaatggtgatgtaactcttacttttacaccagatgatggttacatggttaaacaagttttagtcgatggtcaagaagttgactatgatcttaattcaaatcaatatacattaaaaaatgttattcaaaatcatgatgttaaagtaattttcgctcttaaaactagtgataaaacatacggaatttatcaatttgaagactatgatcaatggagtggcggaaatttaaaagttgaaacaagtaaagatagtaatggtgatagtttaactaatatcggcggaacttatgatggcgcttggataaaatacagtgatatggaatttgatggtcaaggcttaaattcaatcgatgttagatatgtaaataattctagtcgctgtggaagtaacgcgcgtttagaaatatatttagatgagatcaaagataatccggcggctactgttttacttccagtaacaggaagtgattggagtgtttataatactactactgctattttagatggttcaattactggtagacatgatgtttatgtagtaatgaaagcagatgtaagcagcagttatccatatgtaggtaattttgactggattcgttttaatgaggcgcctaaatcaagttatggacaactagaagctgaaaataagacagagatgtcaagtggtttacaaatcgaaacatctaaagatttagaaaataattcgttaataaacattgctcatactttcccaggggactggttaaaatatagtaatttaaattttgatggtaaaggattaagcgaaatttcagttcgttatgctaataatactagtcgctgcaacagtgatgctcggttagatttctatttggatagtccagaaggaactccttttgtatcaataaatttaccaggacgtcaaagcagctggtcagattatcaagttgctacagttacattagatcaagtaattagtggtaaccatgatctatatgtagtgatggcaggtagtgatagtagtaaatatattgctaatatagactggtttagttttaaagaattagattatgataaaacaagcttagaggcattgtatcaagaaagtttagtgattctagataatcagaatatgtatactgaatcatcatttaataactttaaagaagttatggatagtacaaaaattattcttgatagtaatgttgtgactcaagaagtaattgataaccaaataactttattacaaaatgcaattgatcaattagaaatagcagttgaaagtgataaaacagcattacaaatggctgtagatacagctaatacattaaaagctcaaggagctttagataatgtcgtaccagcggtagtaacagaatttgaaagtgcattggcagaggctgaaagtattttagctgatacaaatgcagatcaaacaacaattgatacttcattctatcgtttagctaatgcgattcatatgttggaatttgtaaaaggtgataagagtgctttagaagccttgatcaatgaagcaaataattatgtagaagaaaactacaccccagattcatgggcaggattcaaagaagccttagatgcagcaattgaagtcatgaatgatgaaaatgctttagaagctgatgtagtagaagcgttaaataacttaaaagatgccatgacaagcttagtgatcagagttgataagacaagattacaagaagcatatgacaaagtaaatggcttagataagagtctatatacagaaggaagtgttgccaacttagtagaaccaatggcaaatgctaaagccatattagaagatccaaatgcaacacaaacagatgtagatagtgcttataaagccctaattgaagcatacttagacttaagattgattccaaataaggatctattacaaggattgatcaataaggcaaatagcttaaatgcggcaaattacagtgctaagacatggtcagtgatggcagaagcattagatgaagctaaagcagtattaaatgatccagaagcaacacaggaacaggtagataacgctaaagaagtattaacgaaagcgattgctggattagaagtaaatgaagcaagcaatccagtaaaagccggtgatacaacagcaagtgtagctactggtgatgaaataaatattaggatttttgcaataggattattattatcagctgtaataattttaagaaagaaaaaagaattaagctaatttttattggtatgcaataatttgttaataaaaaagagatcatgaacctatttaatggttgatgatctttttctatttattaatattctaaacttgtttttagtccaattaagtctataaaaaactagtcaagtatttcatgatacaataatcaattaggaggagaaggaatatgagggaattaaaagaattgtcaaatagcttaaatgatactgtagaaaaattaagagaggataaagatattttaaaagctgtaaaaagactgcaacaaataaaaaataagttaaacaaaataattaaagaaaatgtttaagggtatcgataaaattagatacccttaaacattggtaagatctatgtaattaaaagtatattaagacagtatttgaaatttaattaataacaagagtttattcaatacaattatttaattaaaaatgaattttactatgtatattaattacaaaaataaattctataaaaaaacaaatatatcatgtttttttattgttgatgatagaaggtattacatttaagagtcaatgatctcttaaaaaatgagtaaacagctggatatataattgattagaaatggatgatggggcgtgatatgatacaccgattactagaaaacgttttctactattgagataaaggaagtactttttataaatacttcctttatcctctaaaataatctacacatttttgtcgacaaatccatatatattatctactagttgctttaattgttcaaaatcatcttctttaaatatatattcgtatattaatttaatttgtttttcattcaagccttctatccatttactacaatccttttgatatcttcccttgagtaattcaacaagcatttctttttttccaatctcaacaccctgttcaataccttgctcgataccctgtttgattccttcttcaatccttttggctgtcttttcttcgcgctccatctctaaggattcagttctaagcttcgctaaggctaactggttcgctaatgaccatatcggttcattgcttctaaacttgtcatacatctttatcaccatctccactatatcttcttctctttccttcattatagcagtgtattcattttttataaacaaataacataatctttctaaatcatttaattctgcgattcctttttctttgatgatcttatcgatatgtctcatcttgataaaatagcggtaattaagattttctttttccagctctccctgatcatctcgaaacgcataatctttgatcaaacgatcatcatcttcattgataaagatgatttgatataccggtcttagctgatgatatttttcaccggtatcgatctgttctactaacagtctggcaccatagaactgaaagcgggtactttcgctattactattgccagccatttgcatctcgatatcaatgactctgcctttttcatcaacagcacagatatcaaggataatatttttagcgaggaccgtattttgattgatttcgggatttttaacgatcatttgttggcagtcaagatgagtgacagatttaacgataaactttctcagttttatagattctaaagtatctctggaaagcagatatttaaagaacaggccattattaaagcgaacattattgttattatcgataacagttttttcatgaatcatattttttcctcctcattatcttttacaatctaaaaaggagaattgcttttataaattgaaaaatattcaaataaaaatataaacagacaaaactgcttaatgttttgtccatttattttttatcactaatatttaccagcttctatcctttgtttaaatacttcaaaatcatcttcttcaaatatatattcatatattaattctatttgcttttcactcaatccttctacccattttgaataatctttttggtaacgcttttctaacatttttatacagcgattacgtttttctctttcaataccctgttcaataccttgctcgatgccttttttgattccctcttcgatccttttggctgtcttttcttcgcgctccatctctaaggattctgttctaagcttcgctaacgctaactgattcgctaatgaccatatcggctcattacttctaaacttgtcatacatctttatcaccatctccactatatcttcttctctttccttcattatagcagtgtattcattttttataaacagataacataatctttctagatcatttaatccttcaattcctttttctttgatgatcttatcgatatgtttcatcttgataaaatagcggtaattaagattttctttttccagctctccctgatcatctcgaaacgcataatctttgatcaaacgatcatcatcttcattgataaagatgatttgatatactggtcttagctgatgatatttttcaccggtatcgatctgttctactaacagtctggccccatagaactgaaagcgggtactttcgctattactgttgccagccatctgcatttcgatatcaatgactcgacccttttcatcaacggcacagatatcaaggatgatatttttagcgagaaccgtattttgattgatttccggatttttaacgatcatttgttggcagtcaagataagtgacagatttaacgataaactttctcagttttatagattctaaagtatctctggaaagcagatatttaaagaacaggtcattattaaagcgaacattattattatcgataatatttttttcatgaatcatattttttcctcctcattatcttttacaatctaaaaaggagaattacttttataaattgaaaaatattcaaataaaaatataaacaggcaaaactgcttaatgttttgcccatttattttttatcactaatatttaccagcttctatcctttgtttaaatacttcaaaatcatcttcttcaaaaatcaattcaattattacttctaattgcttccctgttaagctctctatccattcctgacagtcttgatgatactgttttttgatcattttaatacatgtttgtctaagagtttctttttttccaatctcaacaccctgctcgataccctgtttgattccctcttcgatccttttggctgtcttttcttcgcgttccatctctaaggattcggttctaagcttcgctaacgctaactgattcgctaatgaccatatcggctcattacttctaaacttgtcatacatctttatcaccatctccactatatcttcttctctttccttcattatagcagtgtattcattttttataaacaaataacataatctttctagatcatttaatccttcaattcctttttctttgatgatcttatcaatatgtttcatcttgataaaatagcggtaattaagattttctttttccagctctccctgatcatctcgaaacgcataatctttgatcaaacgatcatcatcttcattgataaagatgatttgatataccggtcttagctgatgatatttttcaccggtatcgatctgttctactaacagtctggcaccatagaactgaaagcgggtactttcgctattactgttgccagccatctgcatttcgatatcaatgattcgacccttttcatcaacggcacagatatcgaggatgatgtttttagcgaggaccgtattttgattgatttcaggatttttaacgatcatttgttgacaatcaagatgagtgacagatttaacgatgaactttctcagttttatagattctaaagtgtccctggaaagcagatatttaaagaacagatcattactaaagctaacattattgttattatcgataatagttttttcatgaatcatattttttcctcctcattatcttttacaagataattagagaaattacttcttttttatagaaatattttatggcaaaaaattacagagatgtttttttgctgtcagcaataattatttatgatagaattatttaaatgataacattttcatttagtttaaaggaggaaagaatagtgtctaaatatgttatggctttagatcaaggtacaacgagttcacggtgtataatttttgatcatcaaggaagggttgttgctaaagcgcaaaaagaatttcaacaaatatttcctaaaccaggatgggtagagcataacccattagaaatatggtcatcacagttatcagtgatgattgaagctcaggcgttaagtcatacaaaggcaacagattttgtaggaattggaataactaatcaacgagaaactaccattgtttggaataaagaaacaggggaaccgatttataatgcaattgtgtggcaatgtcgcaggactgctgaaatgattgataaattaaaagaagatggcttagaaaagaaggttattgaaacaacgggattaatacctgacgcatatttttcggcttctaaaattgcctggatattagaaaatgttgctggcgcaagacaattggcgaatgaagataaattgttatttggaacagtcgacacttggctgatttataatttaacagatggtaaagtacatgttactgattatacaaatgcctcaagaacgatgttgtttgatattaaaaatttatgttgggatgaagaattattggcatattttaaaatacctaaaagtatgttaccggaggttaaaccatctagctgtatttatggttatagcaaagaaggaattttaggtggaagtattcctgtttgtggagcagctggagaccagcaggcggcattatttggtcaatgttgttttgaagctggagaagccaaaaatacgtatggtacaggttgttttttattgatgaatacaggtaataaaatatatcaatcaaaaaaaggcttgattacgactattactgctagtgataataatgaggtgaattatgctttagaaggaagtgtatttgttggtggagcagtaatgcaatggttgcgagatggtttaagaatgattaaaagtgcacctaaatcaagtgattatgcgacaaaaatagatgatacaaatggtgtatatttagttccggcttttaccggattaggagctccttattgggatccatatgctaaaggaacgatcgttggcttgacaagaggaactggcaaagaacatttcattagagcggcattagaatcaattgcctatcaaactaatgatgttattcaggcgatgctggaagatacaaaaattgatttaaaatgtttaaaggtagatggtggtgctagcgctaatgattttttaatgcagtttcaaagtgatatttctaattgtttagtgcatcgtccccaaataattgaaactactgctttaggtgcagcgtacttggcaggattagcagtaggtttttggaaaagtaaggatgaaataaaaaataactggctgcttgatcaagaatttacaccagttattaaagatgatcaaagaaaaaaattattagatggctgggcaaaagcggtacgttttacattgatgtggaaagatgtttaatggatatcaaaaatagctaatttgagataattcaaattagctatttaaatatataattaatcttcagtaataaacattttataaattgcacgaatagcattattaaaatgaacatttttaacaccgacaatgatgtttaattcagaagatccctggtcgatcatcttgatgttaatattttcatttgctagagcagtaaagacttttgcagcagtaccacgaccatctctcattcctctaccaacgatagcaattaaagctagatcagattccaattcgattgaatcaggatgcacagctcggtgaattcctgataaaatttcttgttctttatcaataaatgattcagtttcaacaacgattgtcattgtatcaatacctgaaggtgtatgttcaaaagataaattattatcctctaatacttgtaaaacgcgacgaccaaaaccaatttcactattcatcatatctttttcaatcataatagttgcaaaccctttttttccggcaataccagtaataacatggtccggtttatgacaagttgtttcgacgatcaaagtcccttcatcttcagggcgatttgtatttttgatttgaattggaataccttcattacgaattgggaaaattgaattttcatgtagaacacttgcccccatatatgataattctcgtaattctttgtatgtaatcgttccaattgtatcagggtttctaacgattctaggatcagcaactaaaaatcctgatacatctgtccaattctcatataaatctacatgaccattacgggcgatgattgaaccagtaacatcacttcccccacgtgaaaatgttttgatcgtattactaccatcatttaaagaaccataaaaaccaggaataactgcattttttacttcacttaaacgtttagataaaattggatcagtttttgcttcatcataatttccatgttcatcaatgaaaatgacttcactagcatcgatgaattcgaatcctaaataattagctaagacaataccatttagatattcaccacgactagctgcataatcaataccaattttattttgaaaagctttttttattgttgcaaattcttgttctaaagataaatccagttttaactcatcgatgatactttgaaaacgagctttaactagattaaagttgtcttcaaaagtttttttatctttagcgttatatgtttgatatagtaaatctgttactttaatatcttctttgaatcgcttaccaggtgctgaaggcacaacatagcgtcgtgattcgtcacttttaatgattttaactacctttttaaattgagttgcatcagctagtgatgaacctccaaatttgacgatttttttcataatgttcccctttatataaatgtttaataaaaaaataccattttttaaagcatacatcaagttaaatcttgaaaaagaagagaatttatcataatttgatcataagactaaatttgataaaaatatgattatatcatgaaattgtaattatcattgtttattgtaaacttgatggtggataagtaaatactctaatatttattttaaaatcaagtgtattaattatatttaatgtctatgaaataatgaaaattttgaattagaaatttagttgataaaaaatagttaacttatttgtaatatatgatagaattaaattataatttaaatgaaaaggagagcacatatggagtatattaaattaattgggatcgtcataattgttgctggctttgctttgaaattagacgttttggcagtagtaatcgtttcaggaattgtgacaggattagtatctggattggatattattgaaattttagagattttaggggaatcttttgtaaataaccggttaatgtccattttcttgatcatttttccaattatagctattattgaaagatatggcttaaaagaacgagctgcttttttaattgggaaaataaaaaatgcaacagctgggaaagtattatgtatttatagtgtaatacgttctatagcttcagctttaaatgttagaattggtgggcatgtacagtttgttagaccattgattctaccgatgagtgaagctgcagcaaaagtagcaaaaaattcacctttaacagaaaaagagggtgaaaaaattaaaggattatcagctgcagtagaaaactatggaaacttttttgctcaaaactgttttcctgctagtagtggagttgttttgattcaaggaacattagttgaattgggatatcaagatgtgacattatcgatgattgcatcttcatctgtttatattgcaattatttcagtcatacttacttttgttcaagtactttggtttgataaaaaaatgaaaagagggagcaaaaaatgatagattttataggtacatatttaccagaattattttatgctttatgtggacttgttagttttgatacagcatatcgagcaacaaaaaatgaggaagctaagttagggacttcattattctggtttattttaggtgtgatttttatgtttggtaaaataatacctccacttgcaataggaatattattagtaatcatgggttgtttaacagcttttaaacaggttaagatgggtaaatttgtagaatctacaccagcatttcgaaaagctgctagtaagaaggttaaaaataaaatttttattcctgctgttgcaataggaatcatggctttgattttatcttttattcaatatacaggtgatggattttattttgcttttaggtcaattgcaataaaactgatttcatttagtagtgatgtagaaattaatatgacagctttaaacggagctgtaatgacaggggtagcttgcttagtggcattattgctggcaattattatttgtcgaccaaaaatgtcagaaacaagatcagatacttcacgacttttaatgcaggttggtgccgcctgtctattacctcaattattaggggctttaggtagtgtattttcagctgctggagttggtgacgttatttcaaatatgatttcaagtattattccagtaggaaatcctattattggcgtcgtagtttatgttttaggaatggtcatttttacaatgatcatgggaaatgcatttgctgcttttaccgttattacgattggtattggatatccgtttgtaattgctcaaggtggtaatccggctgtaattggtgctttagggatgacagctgggtattgtggtacactcatgacaccgatggcggctaattttaatattgttccttgcgcagttttagaaacaaaagatcaaaaatggacggttattaaagaacaggcgccaatggctttgatcatgatcgtaattcatattattttaatgcttgtattaggtttttaggaggaaagttatgaagatattagtaacaggttttgacccatttggtggtgaaaaaatcaatccagcaattgaatcagtaaaaaaactgcctgatgaaattgccggtgccaaaataattaaattagaaattccaactatttgtcatcaatcattagatgtaattgataaggctattgaagagtatgatcctgatattgtcttatcgattggacaggcagggggacgaagtgatattacagtagagagaattggaatcaatatcgatgattgtcggattcctgataacgcaggtcaacaaatcattgatgagccggtttttaaagatggacctgctgcttattttgttaatcttccaattaaagcaatggtagcgaagattcaggcttgtcaaataccagcttcaatttcaaatagtgctggaacttttgtatgtaatcatgttacttatggagtgagacatattattgaaactaaatatccagggaaaaagagtggttttattcatattccatttttgcctcagcaagtaattgataaaaagaatatgccgtcaatgtcattggaaacgattgtaaatggattgacagcagctattgaagcaattgttgaaacaaaagaagatcttaaaattacaggtggtacaacacattgatgaatgaaaagatatttgtttatggtacattgcgcctaggcatgtacaactatgatcaatatttgaaggataaaaatagttttaggcaatttgcttatgttaaaggaaaactgatgacgcttaaaggaaagaattatcctgcattattattagagggaagtggtatggttcgaggcgaaatacatgaagttgattctaaatttataggtgttttagatgaacttgaaagttattttggtgaaaacaacactgataatgaatataataaagtgttttgtgatatctatgatgataataataaagtaattgatcgtattcctgtttatgtatataatactggaaacaatgaaaatgttcagttattagataaggttattgaatgtggtgatttttttaagtatgtcacattgaataaacactattaatggtttgaatacaaaaaatcacaaattttagaaatgaaaagattttataaagagctgtttttatgcagctcttttattataaatattttgatgcctattattgaaaaggttacaagtcttactatatttgggtattcaatgattctatgaatctaaacctacttttgataactggtagcttgctttatattgtccatgtcttgtgaataagtttaatattcaaactgtaaataatgattgcgattgtttttaaagatgaggaaagttattttattaaaaatataaagaatattaatcaaatatcgatgatcatgaattttaaatattatttttgagataagatatttttgattatctccccagtaatcatttttaagaattattaaattatttggtgactagaaaaatttgtctataactacaattgttggtaacaagttaaaaaaaatgttacctttttttatacagagaagacgaatttgtgaatattaaaaaaaagatgggatgatataatgttattatatggggaaattgataaaaagaaggtgattcatgaataatcgaaaatactacttatagtaaaaatgggagagtttaatctgaataaaaaataagaacggaaaataatgttttacctaaaaaagtgcataaagcccctttccccaaatggaaggctattctgtctgaggtgagttgctagatttcttgataatgaattgtagaatttcttcatcactcaaaccagtgcggctgagctgattgaaagcatttcttaaattgtttttgatgtattcgatacgctgttgttttgttgtttctacgtctgccatatcagatgggttgaaaacctcacctgttttaagaatgtgatagatgactacaagtatttttctggcaatagctatgatggcacgctttttgccacgacgttttgaaatcctgctgaatttgtctgcatagtaatcacaatttttgtctttgacagcagcgtgtgcaacctgtacaaggcatggtttgatataaacacctgccttggaaatcttaactgatttctttttaccagcagactcgttacagccaggtgcgagtccagcccatgcggcaagcttacgatgactggaccactgtgatacatcaatacccagttctgaaatgatgataattgcagattttctactgacacctggaatagtcataagaagctggatatagttttcataggcagagaccattatattaatatgatgctgaatctcatcaagaagagaatcaacatattccatatgtttctgaacgattctgattcttgacttcagataatgattcaaatcagtgccttcaacagcactgagaatatcttcatcagaagatttacatctgccatgaactttagaaagaatgtcttcactggtatagggttcatctgataaaatagtatcgacaatagaggaagcggatttaccaaagacatcagaaaaaacaagatcaatcttacagtttccaacagtcagggcattttggaaacgattcttctcagaagaacggatattgacaagcttgaactgatagcgagtaaattccctgaggatacggatattcttttcagggatatagctagatctgacgataccgaatttaaagagatcagcgatccatttggcatccttgttgtcatctttctcacctttgatagccttgacccatttaggattggcaacaacgacattggagatgtggtcctccaatgcattgtatacagggacatagtatttaccagtggattccatgcatacattttgacagttgttatcgataagccattgtctaaactgaatgagttggttattgaaggttgagaatctttttttaatatacctgggtttgacggattcagagatgcagataacagcaacaatgaaagacttatgcacatcaacgccacaggctctagggtaaacgatttccataaataaaaagctcctttcagaatatagagaaggagctcagtgactgactgaacaacactaaaagattaactcaagtcaatgattaatctacagactcaaaagacatactcatgtgtgcttgaaaagttcagccctgcactggttatgatactgttttgaactgaacgagttgcagaaatctacaactcacctccccgtgctttgtagtgtaagactccttcagtaaaaatataaaataaaatgcctgcacaaacaagactttattcatgactatgtgtgccttggagacgcaggcggaaaggaatgtaaggttatgatgaaagtaatagttatttttaatatgctattactttatattatatattaatgtttgattattatagtgctgatgagtacttagtaattattattatggattaaatttatttttgatgtttttaactattaacttataatgaaattaagttaaataaaaaaaacaaattatttgtttaagattagtgttatgtatgtgttgaaaagtgaatgggttataaataaaactagtttaagcgcttttaaagtgtttagatatgtattattgatgaataaattaatttttaacacgatcaaaaacacagaaaggaaaaatgatgaataaattaataaaaaaaattaaaataattagtctggtagttttactagttaacagcatttgttcaattggatggatacctagtctgtctgctttgacaatagatgaacatacaccagttttgtattataattttgatgatgaaagtgctgttgatcaaatgggaaattattctggaacattaataaatgagccacagtttattaatggaaaatctgattttggtaaggctatgaaagtaacaggtaaaagttatcttcagttacctgcaaattttaaattatcaaatcaagattttacactgtcttttttagtacaatcattagaaacaaaaaatgatacggttttgttcgcaaataaagatggtgtatctggaaatgctgatggctttgcgattatgaattataatggggtatttggtaatgtgggatataatggtaatcgttatgatacatcttcatattcacgtgatgagactgtacttgatggaaaatggcatcatgtggtaataactgcagatcgtgatcagagtttagcgttatatgtagatggtcgtttatctagtgaaaataaaagttttagcgagttggcaggaatttcattagatacagcatctaattatgtcttaggggcaggtagtaccggtgagtatcttcaaggtgcgttatatgatgagtttatggtttatgatgcggcattatctttagaagaaattcaatctttatatttaaaatatgctgatgatgttggaactgaattacaagaacagcttgatgctttaactgcaggagaagtaagagtttcattaggtgctgatcttgaaatgaaagctagggcagttacaacatttatagaaagtcagttagatgatagtcttggagtcagtgttgctgcttggatggttaatgacaatacttatttagttagcttatcaaaagcaggagtaactgtaagtaagcaaatggaatttagttttgtggaaaaagatgtacttacggtggctacttataatatttatggttggggttatcctaatttaaattctattaatgaaaaattaaaagaaattgatgctgatattattggattacaggaagcaaatcatcagttagatggtaatggtcaagtagagcagttaagtaatataggaacatatccatattatgcttttaaagaaggatatggaagtagtactttttggggtggtagtgctattgtttctaaatatccattagctaataaaggtggggcgaattatgagatcaatgatgatactaatcgttcttatgttcgagctactattcaaatagatgataaggaaattgctttatataatactcatattgtatggctaagagatcctgaattacatgctcaatataaacaagctcagattaatgaattgattgaagctgtaaataatgatccaacaccatataagattattactggtgattttaattctgatcaaagtaaagaagaattagatcagatgttattgaattttaatgatgcaaacggttggaacaatgtgtggtttgaaacgggagaaatggattcttcaatggtgattggatgcatcgatcatatttttacaactactaatattgagtttgtagacattgatgtagcaaatggggctccatcagatcatgatattttatatgcggatttaagactcaaagattcagctactacattgcctactcaactgttggattacactttaaaagatgctaagacttatttagctaatgaagctagatatgaaagtgttggaataaataatttaaaaatggttgtaaatgagattgaaaatcaaccagttaccgaagaaaatcgttatcctaatgttattgcaattcgtgaagctatatctaaactacaagaaaaggtatcacctattagtgatccattcatttattataactttgataatgatgttaataatcaatatcaaaactatgatggaaaattagtaaatgatcctagtcttgttccaggatttaaaaacaatgctttagaaatcggtgaaggatatgtcgaaattccgggaatgaaacttggtacagaagatttcacaatttcattctggtttaaatctaatgaaacgaaaaatgatacagtaatttttggtaataagagtggcgattcaggtaaagatttgggtatcttcttctgtaattatgatggcttatttggaaacgttggaactggcagtgttagatatgatacctcagcaaataatcgtgataaaatagctatggatggtaactggcatcatcttacagttgtaggtgaacgttcaaaagcactaagtctttatgtagatggtaaattatcttcaagtaatactgattttgcaaatattgtaggattaaatcttgatactaatgataattatgttataggagctggtagtcaaggtggatatcgtcaaaaaggtaatatagatgaatttaaagtatataactatgctttagattcagcacaagtatttaaaacttatcaagattactttatcgatagaacagaattacaagcgttatatgatgaattattagtgcttaaagaaacagattatacaaaagattcatggacagcactgcaagaagcattagatgaagctaaaacagtattggataatgctaatgcaatgcaagaagaagtagaaaatgcaaaaacattattacaaacagcaaaagaagaattagtaaaagcggaagaagtaacggtaaataaaaccgcattatcaatagcagttgagatggcaggtaatgtaactgaattagataaagttgttccagtggtagttaccgaatttaaagtagcattgcaggaagctcagactatcttagctgatgaatcagttagtcaagaagaagtagatgcctcatttgcccgtttatcagtggcaatgcatatgttacagttctataaaggtgaaaggagtgaattacaaggattgattgtagaagcagaaggattagatggaagcagatatacagataaaacatggaatgatctaatcccggtattacaagaggcccaagaagtattagctaatgaaagtgcaagtcaggaagaagtagataatgtctataatgcattagtaaaggcatacttagagttaagattaattccagataaaagtttattgcaggaattgatcgataaagcacaatcactagatggtgcaaattatagtgcaaagacatggaatgtggcagtagaagcattagataaagcaaaagaagtattgattgatccagaagcaacgcaagaagaagtagataatgccaaagctgcattagcaaaagcggttgaaggattagtagtagataattctccagaagtaaaatcaggagatacaagctttgtaaataatactgttgtaacaggagatgctgcttcgttaatgtcaggattagtaatgctgagtgcattaggtggctgcctatatttatttaaaagagaagaataaagattgtagaaaattaagtcttgaaaagttttaaaagagggttagtaaatttactaatcttcttttagcttatttataaaaattgaatgaattaaacaattattatgtatgcttaaataggtaaggagataattattttttataaaaaagatgatactctaaatattttgttattctggtatttgtagatacacttttttagatatggaaaaagcagttgatcttaagattaactgcttcaacattaaaaagtaaactttttatttcttttcttcttttttctttctatcccaccatgtacctgctaatgaacaagatccacctatagttataaaagctatcattatgatccaaaattccatatttcttcctccttttaatttgataaatattgacaaataaagattataatcaaacatacaacaagtgcgattatgcctgctacaagcgcaaatataattttttgataatttctttttcctatttcttgttgtgtttcatcgtaagttaattgttttccatcaataaatgctagaatttctttataagtttgaatgtcatgattctttttaaatttttcaatcgcatttgctgtatatagtgttacagcaaacaaacatagccaaataataatcccaatatatccatcaatactaaataaaggataagcacttatagttacaattatcaattcagctagaaaaacaaaactcatcacattaaactttttaattgttgctttttcgacaacttccctcatctcctttatatcttcttttataaaattatctaaagatacattgaagacatcagatagcattattaaacttttgatatcaggacaacttttatttgtttcccagtttgagattgtctgtcttgagacaaataccttaagagccagttcttcttgagaaatcttttgttgttctctaaatttcttaattcgtaatccaatatccatttttttaaatcttctccttttctcctttattgtatatgaatatatattttttgtctgtcaaaagtctttgacattgcctttttacttctcaaaattactgtaaaatattaaaaataagtttaataaatcttttttatagaaataaatgatatattggtaactataatatatcattatgttatttctttgtttttgcaaagtatgattttgtggattactatctgacttcctttgttcttaaagatatcatgtgctttaataaactattctattttaacacttcgatatttggcatttgccattatcatctgttgtaaagataacaaaggcaatctttttcataattcttaatctatcatttgggtaataaaatggttgtctacgatcttcattttttcttgttgcaatactgatgtttttataagtcagtatatttgagataatatcttatattaaggctgtagtaataatttgatagtattttagtggctaaatatgttgtagaatcaatgttttttgcagaagttttaagagatcatagttgtattatagcttttataaatttgttggtagataagagaatatgtttaatatattgattttaataaattaagtgacatttttgatgttttgtcacttaagttgaaacactcatcaagaaatggaaatttaaaaatcgtatttttaattatataattaatttaagatctatttaatatttaaaaattaagaatttggaggtgaataatggaggaatattttggaattgatattagataagatcaagaattaatataaaataattttaaataataaaaagtatttagaaagggaaagatgatactaaaaagggttaaattatgaagaaaataaggaaagcagctaaagctgcatttaagatattattagcatcttctttagcatatacagcgttaatgccggtaaaagcatcaaatttaagattaagtaatgatgaatttctattacctgtaatgtcagtttcatttgatgatgaaaatgctaatgatacttctggaaatgataatcatggtacagttgtcggtgatgtcgaatatgtagagggaatcaaggggaaagctatccatattcaaaatagtgatgtagcttatacttcaaatatagcaaaacaatatgtaaattttggtaaagcaactgatttacaatttggcaatgatgatttttctattgctttttggtataaggggaatactactaaatttacagatggagggataattagtaataagagctggtctactggttcaaatgtaggatttattgtagctgaatatgatagcaagcttactttaaattttacagcaaatggttcaagccgtggtgatactgatgatgctcctatcactaatgatcatacttggcaccatattgcagcagtttttgaccgtagtgataaaatgtctctttatatagatggtgaagaattttcatcttcggatataagttcacaagcaggaagaagtatcgatgcttatgattttattttaggtgctgatggtttaaaacaatatggtatcgaggatgctgtaatcgatgaattacaagtatatagaggagtattacctgaaacccaaatttctgatatgtgtgaatcttatattttagaaacaaagatacaagatttaagaaataaaattacagaatatgaacatgcagtaaatgatatgaatattgctcaggaaaaaaaagatgcatttactatagttattaatgaagttgaagcagggttagaaactgttacaagtttacaggaaataaaagaattagatgaaaaactccaaaaagcatatagtgattttggtaaaccagcagatggtaaattagaatttgttgtggtaagtgatactcatgtacaatctagtgcaagcagcactagtgctcgtatttatgatgaaggtttaaataagattgttacaactatgccaaatgctaaggcagtcattaactgtggtgacttttcaagtgatggtgcagatagtgagtttgcaagatattattctattattgacaaatatgatgaaaatttgctatttgtcaatgctttaggaaatcatgatgtacgctggacatctcaaggatgggatggagtatatgatcgctatatgtcatataatcaaaaatatatgggcgatacagataaagtatattatgatacatggatcggcgaaggtgaagatcagtaccatttcgttgttataaatacagaatgggatattaaagacagttcttatatttcaagtgaacagttagaatggctagataaaacaatggcagaaggtgctaaagatgataaaccaatctttgtagtacttcatgaaccattacgtaatacaattgccgatacagacagctataatggttattctgatttcccattagatgaaggtccacaggattttgccttaaaagaggtattaagaaagtatccacaatcaattatcctaacaggacacgtacacgctggtcttgggacaaatgaaattgttgagacagattatggtacgttggtaagtgttccttcttatttacgtgcagattctggtgatcctcaaaatcagcttggttattatgtaagtgtatacgatggaaaagttcagttaagtatgtacgattttgaacatgaagcatggttacctgcttatcactatacagttgatttaacagatgaagtaccggcaggtaaagtattggatgtaacatttgatgatgaaacagcaaatgattcatctggaaataacaacaatggaaagcttgttggagatattgaatttgtagatggggtaaaaggaaaagcgattcatattgtaaacaatgaaacagatgtagcagcaaaacaatatgtagattttggcgatgttgaaggtttacgatttggtgaagatgattttactatcatgttctggtataaaggaacaaaggaaatggataccgaaggagcaatcatttctaataaaaattgggattctggagctaatttaggatttgcagttggtacatttacagatccaagacctggcattggattgaactttactacagatgcatcaagagcagatacagaacgatatgcagctgctgtcgatgggaaatggcatcatattggtgcgacttttgatcgtgacgggatgatgacactttatgtagatggaaaagtattagaaagctgtgatatttctggacaagcaggaaagagtattgatgtggatacgttatcacttattttaggggcagatggaaataaacagtatcctattaatgatggatatattgatgaattaaaaatttataagaaagtcatcgaagcatatgaattagaatcagtagttgctccatataaagtcgaaacagaagaagataaagcaacagtaacttgggatgcattggaagacaaattcactcctgcctatattttatttaatggagaaaaactaacgattgattcagaggcaacgagctacgaaattacaggattaacagcaaatacaaaatatactattgaagttattacacgtgataaagcatatacaagaaatttagtatttggacatgaaatagaatttaaaactgtaggtgggacagaagttgattttgcagctttaaatgatgtaattgcaaaggctgaagatattgataaaactcaatatacagcatctagtgtagctgttttagaaaatgtattagctgaggcaaaagctcttcttgataatcaaaatacaacccaggaagaagtagatgcacttataacaaaattacaaacagcaattgatagtttagcaccagtagaaaatattgagactaataaaactgcattagttattgctattgaaatggcagaaaaagctgacttagaaaatgtcgtaccagttgtagtaaccgaattcaatgaagctttaacaaacgcaaaagaagtatatgcaaaaactaatgccactcaaagtgaagtagatagtgcttttgctcgactagcaaatgtaatgcagatgttagaattctataaaggtgacaaaacagcattacaaaaaaaagtagatcaaatcaatgatttagatggaagtaaatacattgaatcatcatggtctgatatgttaccagtattagataaagctaatgatgtattggttgatgttaatgcaatgcaaggtgaagtagatgaagcctttacagaattagtaaaagcgttcttgaacttaagattaaaaccaaataaagacttattacaagagttgatcaataaggcaaataacttaaacgctgcaaactacagtgctaaaacatgggcagtagtcgcagatgctttaaacgaagcaaaggcggtattagaagatccagaagcaacacaggatcaagtggataacgctaaagatgttttagcaaagggattagcgggattagtagctaatgaagaaaatattaattcagcagtaaatgctggagatacaacagtaagtatcaagactggagatgacagtttaattggtgtatttgcaggacttggattattaagtatggctacaattgtaacgagttataaaagaaaagaagattaatatttttatttatatgtggataagattttatctttgatatttgaaatataaaaatccaaaaagcattgagatattcaatgttttatggatttttttgtaattgatatacttagatcatatagtaaactacattgagtaataatacagttacttttctaaaaatttaattcgtataaacgataataaattgattattatggtattaaagaattttttgttattattctccaacagcttccaaccattaattatatccttaaattcaggagtagtatgaagatgattattaatagaggatatcttaatatgttaaaatagttgattgaaaaatatgattttgaataattgagatcgttatatctgaaaatgttgtgtttttgattttattgaattaactcatattaataacaaatgtattcaagtaaaaatatgatgttttttttatattatttggattgtaagtagtgttaaaaagctgggttatgttaaattttataaaaaagtttttaaaatttacaaatacaatatatagtttgaatattaaaatttatatatagaaaggggttacgttttttttatgaagagaggtggcaagattaaataagaaatttttattataaaaaaaataaaaaggaggaaattatgaaaactaagataggagctatatttttaacattaatgatggtaattagtttattgccgtttacagcaattaatgtagaagctcaggggacagaattaactattaatgactctcaaaccggaaatgatttacatcaatttaattttaaaggtaactggaaagttagtacaggatatcctgatcgtttctatggtggagatgaacactggtataattttaatagttgttatactgaaggtgatgacttaccaagttatgaaattaaatttaaaggtactgggattgaattatacggtgaaaaacaatcaggtttaggtatttataatatttacttagatggagaaaaaatcgatagtgtagatgcttatagtgctagtcgagtagcatctggcaaaatttatgaaaagactggaattgaatatggtgaacatattttagaagtagaactttcaagaactaagaatgctgcttcaacgggtgtcgatggggaaatcgattacgcgaaagtattaggagttattgaagatgatagtggtgaatatgtttctaaaattgaagacagtgatgtaactactggtaatgaattatttaaattcaaatatactggtggatggacaggtggaactggtcattatgatatgttttcaaatggagatgaacattatgcacatgctggagactactttgaaattacatttattgggactaaagtagagatttatgctactaaagatgctaatcatggcgtttatgatgtatttattgatggagtagcagcgggacaagcggatggaaccactacaggtagtcgtattcatcagcaattaatttatacatcagaagaactaagcgaaggacaacatacgatcaaagtaatgttacctgaagatgcaagtggagctattcaggtggattttgcaaaagtttatcatggggctattgatcctacagaaatttctttaagtgatactgatattattttagaaagtggacaaactaaacaaattacggcagctgttgcaccaagcgttgctactaataaagaaattatttgggaaagtgctgatgaaaatgttgctactgtagatagtgacggtacaattacagcaatcagcagtgaagatgctaatacagttgtaacagcaactgtaaaagggacagatattagtgctaatgtaaatgttagagttgtacctatggtagaatttttatctgcatatgtaggatcaacagatgtattagaaactcaagaagattatgatagtttattgactaattatacagacagctggcaagatgttgcttggaaaggtgatgttttaagttctaagatcgtaacatgtacaagagataaagatgttcataatgcacaaataactgttagtgattttgtaagcggaaattcagttatttcatcagataatgttgaagttaactggttgaaagaaattttagctaacgtaggacgcggtaattcttcagcaccagtaaaagaatttccagatgtaatctataaaggtggtaaaactgatatcgaagcgaattcagttaaatttggatggataacaattaatgttcctaaagatgctaaaccgggattatatcaaggaacagtgacggtaacagcagatgaattggaaaaaccatatgaatttaattatgaatttgaagtacttgatttagttcagccagaaactagtgaagtaggaacacaaattcagatttggcaacatccattttcagtagctaactattatttaggtttaggggaaagaccatcaggtggaatttcaaacgatcttgcagaagatttctatttcacagaagaacactttaatttaatgcgtgcttctatgaaagaatatgctgctatcggtggaaaagatgtagttgctaatatcgtagaagaagcatggaatcatcagtcatattatagtgatccttcgatggtaaaatggacaaagaaagcagatggaacatttgaatttgattatacatggtatgatgcatggatcaacttccaaattgaatgtggtgtattagatccagaaaacggagttggacaaattaaatgttatagtattgttccatggaataaccaaattgcatattatgatgaagcatctggaagcacaattaaaaaatcatatacaccaggaaatgctgattggcaagaaatttggacaacattcttaacagattttatgaatcattcaaaagaaaaaggatggtttgatataacatatatttcaatggatgaaagaggaataagtcagttaagaccagcagtagaattaatcaatggattaacagatgaaaatggtgatagtttcaaaatctcatctgcattcaactttgataacaattcaagctatgattttacagatcaaattgatgatatttcaatcaatttaggaaatgtagatcaatcaacgaatcaagcaacaaaagctttagcaacacatcgaaaagaacttggtttgatgacaacgatctatacatgtacaggagattatccaggaaactttacaatcagtgacccagctgataataattgggtaatttggtatacattaactcaaaatactaatggtttcatgcgttgggcatgggataactgggtatacaatacacaagaaaatattacatatcgttattgggaaccaggggatggatggtttatctatccaatggcaagagatgaaattgatgaaaattacaatgcaactttctacagtacaccaagatatgaaatgttgaaaaaaggtattcgagatattaataaagcaaaatacctaatggaacagtcagaagaattaaaagataaagtaaatgaactagtatcaacactagcaaaaccaagccaaacaacaagttatggaagtgcggttgcagcaaatgaagcagtacgtcaaacagtgctaagtgatgtaagtcgaatgaaagctggtatcattgaattatcaagagaatttattgcaagtcagccaagtgttgatgtaaataaaacagcattacaaatggctgtagatacagctaatacattaaaagctcaaggagctttagataatgtcgtaccagcggtagtaacagaatttgaaagtgcattggcagaggctgaaagtattttagctgatacaaatgcagatcaaacaacaattgatacttcattctatcgtttagctaatgcaattcacatgttggaatttgtaaaaggtgataagagtgctttagaagccttgatcaatgaagcaaataattatgtagaagaaaactacaccccagattcatgggcaggattcaaagaagccttagatgcagcaattgaagtcatgaatgatgaaaatgctttagaagctgatgtagtagaagcgttaaataacttaaaagatgccatgacaagcttagtaatcaaagtagataaaacaaaattacaagaagcatatgacaaagtaaatggcttagataagagtctatatacagaaggaagtgttgccaacttagcagagccaatggcaaatgctaaagccgtattagaagatccaaatgcaacacaagaagcagtagatagtgcttataaagctttaattgaagcatacttagacttaagattaattccaaataaggatctattacaaggattgatcaataaggcaaatagcttaaatgctgcaaattacagtgcaaaaacatggtcagtgatggcagaagcattgaaaaaagcaaatgccgtattagatgatccagaagcaacacaggaagaagtggataatgccaaagaagtattaacaaaagcgattgctggattagaagtaaatgaagcaagtaatccagtaaaagccggtgatacaacagtaagtgtagctactggagataatggtttgattggtatttatgcaagtttatcagttttagcagttgcaggattaggattattaagaaaaaaagaaaattaaatattattaaaataaactaaataaaatgataacgccatatatttctataaattatggcgttattttgcatatttatggataaatgggataaaggtataattttaaactttaaaagttttgagaattgattagatatatttattaaaatagggatacgataaattatacaagtaggattgacgggagaagtaaaatggagaatagggatgtaatattagagaatgctaaagagttagtctgtgataatggctttgataaagtgacagtaaagatgatttgtgaaaaagcgaacatatctagaaaaacgttttatactttttatcaagataaatatgatattttagaacaaattttagttaaggatgtattaagtgaatttagtgatttaatagataaatttggaaaaatggaacttaatcgaccaattattttagaacagatgtttcaaaatatatatgctaataaaaaattttatagtaaggcaatcaatactaagggagaaaattcattagaatcttatttattatattattttgttaaatattattataaaatattggctgatgtaaaagttgaaaatgaaattgaaatggattatttgacatatttttattcatcatcatgtgtaatgttgattaaaaaatggattactgatggctatcctttgacaccaaaacagatggctgaatattatcagaattgggctgtatcagctctagcaaataattatttttattgtaagtaataaggaaattgatttaaaaggtaacatttagattaaaatgttaccttttttaatacattcaaaaataactggtaatgttaatcgaatttgtcgaatgttataatataaacaaggtagtagttttaatgtttaatataaatacatataaaattaaaatatctaacccctttctataaaaaaacgttagattaaaatgctgttttgatttttatgatgtattttaagtaacaaattatgtaaaatactacctctatttttatattagtcaatggggataatatttttatttttatggggaaaagaaaaatgaattgaaaggagaagaaaatgaaagggatagtcaagaaatgcttgcgattaatgcttgttttaggtcttgttatttcaggtgtaatgggacaaataagtttgaataatgttttggcggctacagaaaaaacaagtttatcgtttgaaagcagtaaaaagaattatttagaagttgaaaaaacattagattttattccaaaaacattggaagtttcaattaaatttgataaaccagataatagtagaaaagtgataatgggaaactatgtttatggtaagaactgtttttcattagaactaactgctgctaatcagttgcgttatgttgaatatgtatatgaaaatggaaagatggtcagtgcaattgattataaagtaaatatgccagaattatttgatgaaaactggcataatatatctttagtacgtgatgtagaaaataataaaatattattgtatgaagatggaacattaaaagatacattagaattaaatggtactggaactaatgtattaaaggataatgcaccattggatcaagttcattatgttggaactgatgctagaaaatcattctatttagatgcagatattcatgaaattagaatgtggaacgttgttaaaacaatagaagaaatcggtgatgaagcagaacttaccggtcaggaaacgggtttgatgaataactgggtgttagatataaatgacttagatacagaaaataatgttgttttaaataaggttgaaaatcagccgggattaacagcggttaattttgatttaccaaaagcaaaaacattcttagaatttgatagtacaaaaagaaattatgtagagattactgagaatttagaaaaagcaccaaaaacaatagaattttgggcaaaatttgatgaaaatccaaataaacgtcaattgatctttagtaactatgtatatggaaaaaatggaatgggcgtagaaataactgccgataatcaattgagatatgtagaatttgggtatacaaatggtacgttaacaggaagccttgatgtaagaacaacaggagaggatatctgtaatgaaaagtggacacattttgcagtagtaagagattttgaaaacagtgcagtaaagatttataaaaatggaactgaattagttaatcagaaattaacaaatcagggaacaaataaattaacagaagatttgagttttagtaacaagcattatattggaacagattttagaagttcaagcagtttctatttagatggacaaattgatacatttacattatgggatagtagtaaaacaagtgaagaagtaaaagaattgatggatttagaagtaagcggtaatgaagcagatttattacatagctgggattttgattttaatagtttaagtaatataaatccagtaattaaagataaaaaagttgatggaattgaggcattggcagttaactttaattttgatgaaaataaagatagtattttaaagggaaaatcagtattatttgctggtgatagtataactaatgcggttaaggatccagaaaaaccatactatggatgggctggcagaattggtactgctaatgatatggattggaagaatgccggaatcagcagtgcaactatttcaacagcgttagcttcgtcatatccagaaaacagagtcgtaaatcaattgaatcaaaatagatcatatgactatgttatattacatggtggaatgaatgattcaattgcaatgacagaaattggtcaaatgagtgattcatataatttagaagattttgatattagtacattttctggagcaatggatgaactattatataaagcaaaagaaatgtatccaaatgcaattattggttatatcgtaaactacgcaacacctaattcaacatggggtggatatagcaataacaataaagcgtattttgatcgtgcaaaagaaatttgtgataaatggaatattccatacattgatttatacgatggtggagtggaaatagatggagtatataaatcatatagttatgatattttagaagtaacaagtggtaaaaacatgtataatggattatcaacagaaatacatgtgggtagtaaaggatatgatattatttctccatatatccaaaaatggatggaagagatttcgcaatattcaaacgtaggaacagatttttcaactggcgatatcgaagttgaaatgatagacacttttgatcaaattccattgacttttgaaacgtggttaaagatgccggaatcagcagctactaacagaggtggcgtaattgctggaaatttatttgattcatattatagtgatattccaattgttaattttgaagtatatagtaatggtgtaccacgcatttattggacagtaaatgataaatcttatgattataaagcaacaggtgtcaatgtatgtactggtgaatggactcatttagctattgcatatgatcaagttaataaaaagatggcaacttatgtaaatggtgaaaaagtacatgaatcaacaattgatatagatgtaaaaaaattaaatcagccaatgaaaattggtaaagattctcgtgatgcatataatttcaaaggagaattagcagatttaagaatttggtctacaacaagaagcgaagaacaaattaaaaataatttcaatagagaaattgaaaacgaaacgggattacttggaagctggaagttggatagagaagttaatggacaatatttagatagttctctaaatcaaaatcatgctgaaaattactggatcgatggtgatttatttgcaaaaagtgcagatggttataaaagtattgcaattattccagatactcaaactttagctttatatgcaccatctagtttctctaaattaacaagctggataagagataatcaggaagaattaggtattgaattagctattcatgttggtgatattgttaacgaaagagatagtcatagtcaatggacagctgctaaaaatagtatgaagttattagacggtgtggttccttatgttttttcagcaggaaatcacgatgttataattcaaaaagttgatggtgtatggcatggggtacgtagtacaccattaatgaatcaatatttcccatatgatgaagtatcaagtcaaccatcatttggtggtacttataaagagggtgaagttgataatacttatggttactttacaatcaacaatgtagaatttatggtaatttcattagaagaatcaccacgtcttgaagttttagaatgggcaaataaaataactgcagaaaataaagataaaaaagtgattgtaacaactcatgaatatttaaattttgatggaaatttaattaatgatgaaactcaagatcatttaccttttattggcggttcaactaacggtgaagaaatgtgggacttatatgtaagaaaacatgaaaatattacagctgtagttgccggacatgtagggttcccagatcttgtatctacaaaaaaggttggagataatggtaatgttgtaactcagattctttgcgatgctcaatttatggatcgtgatgactataataatggttcaggtcagggagttggaatggtaatgattttatcattcaaagaaaactctgatgaaattaaagtaaattggtattcaacagtaagaaatcagttttatcgtactaaaaaccaatatactgatacaatggaattgactaaaaaaaccgataaaacagaattacaaacgttatatgatgaattattagtgcttaaagaaacagattatacaaaagattcatggacagcactgcaagaagcgttagatgaagctaaaatagtattggataatgctaatgcaatgcaagaagaagtagataatgcaaaaacattattacaaacagcaaaagaagaattagtaaaagcggaagaagtaacagtaaataagaccgcattattaatagcggttgagatggcaggtaatgtaactgaagaacagttagataaagttgttccagtggtagttaccgaatttgaagcagcattgcaggaagctcagactatcttagctgatgaatcagttagtcaagaagaagtagatgcctcatttgcccgtttatcagtggcaatgcatatgttacagttctataaaggtgaaaagagtgaattacaagatttaattgtacaagtagaaggattagatgaaaataaatttactgtcgaatcatggcaaacattagtaaatgctttgcaagaagccaaagaagtaaacgacaatgaaaatgcaatgcaggaagaagtagatgaagcagtaaaaaatctacaagcagcaatagataatttagaagaaataaaagaagtagataaatcgttattagaagcaatggtaaataaagtattaggattagatggaagcagatatacagataaaacatggaatgatctaatcccggtattacaagaggcccaagaagtattagctaatgaaagtgcaagtcaggaagaagtagataatgtctataatgcattagtaaaggcatacttagagttaagattaattccagataagagtttattgcaggaattgatcaataaagctgagacattaaatgccacaaattacagtgcaaaaacatggtcagtgatgacaaaagcattagataaagcaaaagcagtattagatgatccaaaagcaactcaggaagaagtagataatgctaaagaagtattagctaaagcaatggccggattagaagcaaacgaagtaagtaatccagtaaaagcaggtgatacaatagcaagtgtagctactggagacgatagtttaattggtgtattagcaggtattgggttattaagcatggttactgttataacaagttataaaaaaaggggaaatcaatattaaacgaagaaactgaaataattgtttataataaataaagaagagcataggttgttataaagttttataatgatctatgcttttggatttaaaaagactatttaataatgttgttaatgtcatattgggtggtttttttagatttgatattttgattatttaagctgatattattatttgaattaagaagttaacagctttgtttaataatagctgtaggaattttagaaaaattataataatatagaataattaataagataacttgatgccattaggtaacatttacgataaaatgttacctttttttacacataaaaaaaatatcgataatataaattaaattaaaaaaatgttataataatctatatggaatgcaaaagccagaactccaaatacatgaattatgaaggggttggagttttaatgtattctaaatattttataacagattatgaaagttaggagatgatattgataaaataattaaaattatgattggggaaaagaataattagaattttatgatgttttactatgatagatagtaatggaggcaaaaaaatgaagcgaggaaagaaaattataggagcattattagctgtagcccttttgatgaacatccctgctgttcatgcaagtgcgaatacagttagtgatagctttagagttgcatcattcaatattgcggctgggaaaaagccaaatattgaagcaatgaacagtgctcttgaacaggaaaatatcgatgttgtaggagtacaggaagtagatataaatacgggacgtaataattacgatatgcttgctaagtttgaggaatatgaatattttacagactcacatttccaaaaaactattgattacagtggtgggcaatatggaataggattattatcaagatatgaatttaaagaaaaaacaggagctgctctttcaaatgaaggaagttatgaagcaagagcatatgctcgaggtgtatttgaaaaagatggtaaagaagtagctatttataatacacatttaactcatgaaagtcaaagtttaagagcaaaacaaatgagtgaagttttggcggcgatggatgcagatccaacaccatataaaattttgacaggtgattttaatactgatcagtcaattactgaaaattatccaatgatgaaaaattataatctagctaatggtaaagatgggatttggcataatacatataatcagtatgattcatctatgaatgtatattgtatcgataatattgttactactagaaatatcaaagttaatgaggtaaagatggtagaaactggattatctgatcataatatgctttacattgattgtcagttacttgatcaggaagaaccatcaagacaattattagattgtttattagctgatgctaaagatgtaaaaggatctggatatgagacagatagctatcaagcattacaagatgcgattggtgatgctgagcaattagcagctaatagtagtcaagatgaaattgacaatgttattgcattattggaagcaaaattatcagaattagtaccattaaaaacattagaaaatacactaattcctaaaccagttgaagtatatgaaacaaatggtgagtttacattaaataatgaaacagttattaatgtaaaaggaagaactagtgatgaaacaagtgaattagctaaaattggggaatatattgcaacgaagtttagagtatcaactggatatccattaacagttgtaaatgacagtgatgctattgataacagcattgttttaacaacagccgataatgaagatcagggtgaagaaggctatactattgatactggtgacagtggcgttaaaatcgttgctaatcagccagcaggtgtgtttagagcagtgcagactttaagacagatgttaccagctgatattgaaaagtcagaagtagttagtgatgtagaatggaatattccaggttcacatatcgaagataaaccggaatatgaatatcgtggaacaatgatagatgtttcaagacatttctttactgttgatgaagtaaaagaacatattgataacatcgcacaatataagatgaacaaattacacatgcatttaagtgatgaccagggatggcgtttagaaatcaaaggtgaagaatatgccaacttaacagatctaggggcttcaacatcttgtacacataatggggagagaccaggattctatacacaggaagatttcaaggaaatcgtaaaatatgcacaagaaagatatgtagaaatcattcctgagtttgatatgccagggcatgcctgggcagcgttggtttcattgccaatgttaaatagtaccgaagatggaaaaccatatgcaagcggttatgacaatacaaaaccatatcaaggatgggatgtcggatgggcatcattggaatgtcataatgaaaatacatataaattcattgaagaagttattaaacaggtatcagagatatcaccatcaaaatatttccatattggtggagatgaagcgcattcaacatcaactgctgattataaatattttgtaaacagggttactgaaatagctcaaaaatatggaaaaacaccaatagggtggcaaaattacgataatgcagtagaagataaagaaggaacagttacccaattctggtcaacaggaaatgcaaagatgaacagtgatgtgaaatatattgcatcaccagcagactatgcatatattgatatgaaatatgatagtaactgtgaattaggattacaatgggcagctcaaatatcaattaagagaggatatgagtgggatccaacaaaatatggatcaaaagagcaaatattgggagtagaatgtccaatgtggacagagacattatcaagtttggaagcattggaatacatggcattcccaagaatcttaggtcatgcagaaatcggatggacagcaaaagaagatcgcaactgggatgaatataaagaaagattgatcgttcatggtgaaagattagagaaccagggaatcaattattataaagatgaaacgatctggaaagaaccatatgtaccagtaaacacaagctgggatatgaatgaaggaacaggaacaacagttagtgatagtgctggattatatcctggaacaattaatggtggagtaagctggatagatggagttaatggaaaaggacttcagttcagtggtaatggatatgttgatctaggaatcaaagatttagaaggaaattggactgccagcatgtgggtaaatcgaggagagagcccagcaggaacaacgaacaccgccttattatcaggaaatcagggagaactcaaattagagcagtataataagacaggaaaagtaggaatcacagaatttggagtaaaagattatccgtttaattacagtgcgccaataggagaatgggtacatttaacatttgtatgtgatggtagtggaactactttatatgtaaatggagaatatcaagatagtttaagtggtgttgtacttgcaggaccagcaacaagaattggagctaatgcaaaatccggattagcagattctggtggtttatatggatcagtagatgaagtaaatatctttaatcgagctttaactgctgatgaaatcaaagaattagctaaattacctgaagagatttcaaaagttgaattacaagcattatatgatgaatgtttaactcttaaagaagaaaactatacatctaaaacttgggcatcatttattgagacaatgacagaagttaaaaatgtattagatagtgaagaagcaactcaagaagaagtaaataatgcagtagtattgttacaagctgcaaaagatgctttagttgaacaagtaattgaaagtgataaaacagctttacaaattgctattgaaatggcagaaaaagccgatttagaaaatgtcgtaccagttgtagtaaccgaattcaatgaagctttaacaaatgcaaaagaagtatatgcaaaaactagtgccactcaaagtgaaatagatagtgcttttgctcgactagcaaatgtaatgcatatgttacaattctacaaaggtgacaaaacagcattacaaaaacaagtagatcaaatcaatgatttagatgaaagtaaatacattgaatcaacatggtctgatatgttaccagcattagataaagcaaatgatgtattgtttgatgaaaatgcaatgcaaggtgaagtagatgaagcctttacagaattagtaaaagcgttcttgaacttaagattaaaaccaaataaagacttattacaagagttgatcaataaggcaaataacttaaacgctgcaaactacagtgctaaaacatgggcagtagtcgcagatgctttaaatgaagcaaaagcggtattagaagatccagaagcaacacaagagcaagtggataatgcaaaagatgttttagcaaagggattagcgggattagtagctaatgaagaaaatattgatccagcagtaaaagccggagatacaacagtaagtatcaagactggagatgacagtttaattggtgtatttgcaggacttggattattaagtatggctacaattgtaacgagttataaaagaaaagaagattaaaataaaggcgatgcataaataatgcatcgctttttgttggaaattaggatataatgacaaagatatgacatttgtcacttaaaaaaatatcaatatttaagtataacattattgggatattttatgctgaaattaaatttaaagacattaatgccgatataaagattgtaaaaataattatgattttttataataaatgaccttctttctaaagtatgtttatgtttttgaattgcacttctaaatcaagacaacgacaacctcgcaacaaagacaagtaagaaacactgctataacaaactcatttgggtataaaatcatgtcttgaacaggggattaagtatttttgaagcgaaacataacacgatggtcacagcagtaagaaataaaacttaaaacgaaactattatcttaaaaaatccttaattcaagcttctatacatattatacgagtgggtatgaacgatgaatataaatatgcaaagtaatcaaaagaatattagaagaatgattgtgtttctttgtgtaagtattgtattgatgatcatatggtattattgttatccaaactttaaaacagatatgaatcaatatcgttttggagctacatatatgacgatgaataatcctttttttacggtgataaataatgaaataaaaaaaggagttgaagcaagaggggatatattgatcacattagatccgattcttgatgttgataaacaaaatgaacaaattttggatttaattgaacaacaggttgatgttatatttgttaatccaatcgatgccaataaaataacagtaggtttggaagcttgtaaagaagcaaatataccagtaattgtagttgatgctcctgtttacgatgaatcattggttgattgttcaattgcatctgataattatgaggccggtgttttatgtgctgaagatatgatgtcgaaaagagaaagtgcaaatattattttgttggaacatattagtgctaaatcagcagttgaaagaatccagggttttttagacacgatcgatggaaattctaattatcaaataattaatcgtggtgattgtaatggtcaaattgaattagcgatgccgctgatgcagtcaatgttaaaacaaacacctaatgttgatgtagtaatggcattaaatgatcgcagtgctttaggtgctttggcagctattgaatctgcaaaaaaaagtaatgttttggtttatggagttgatggatcaccagatgttaaagaattgatcaataatggtttgattcaagctactgcggggcaatcaccgattaaaatgggacaattagcatatcaaaaggcaatggaattattatcaggtaacgaaattgaaaaagaaatcgtagtaccagttgaattaattaatagtgataatatatctaattatgatttagcggggtggcagtaatgatatataatgaatatcgttccgtatcttcaatcaaaaatatgatgattgttattaattttattattattttatttgatgcgagtatcattttattttcaactaaatatgtgtgtaataatttaacggcacgtagttttctagatactttagcatatttaccaaacaatccattaaaagtttatatgtattcaatggttggttattcgattttagttgttcttatgcaagttagaaaatcagaaaaatttaaacttaaacagagtttgtgtaacgctttagaattatttttatgcttttttatcatttttaatttatatatgggttataatggggtaagcttattagtttttgcagatattatttttaatactaaaaacggtcgtaatacaaccgtcattataggacttattttagtgatatttttattatcgaactatgatattatttcaaatgttatccctatggcttcgcttgatagttatattagggtatatgatgctgctaccaaaacagcattattagcgactaaaaatattttagaatcaacaaatttaattttatttattatgtttttaattgtctatattgcaaatcagatcaaagaaaatgaaaatattgctaaagaattatcaatgatcaatgaagtgaataaacaattgaaaaattatgctgcggttacagaaaagattggtgaaaataatgagagaaaacgtttagctcgagaaattcatgacactttaggacatgctttaacaggaatcgcggctggagtagatgcttgtattgcaatgatcgatatcgatccagcacttactaaacaacagttaatagttgttgctaaggtcgttagagagggaatcggtgatgtacggcgttctttaaataaacttcgtccgggagctttagaagagcatactttaaaagaagctgttcagaaaatgattcaggaatttagtgatgtctctgatgttaagatcgattttgattatcaattagagaaaattgattttgaaaatactaaagaagatattatttttagaattgttcaagaaagtattactaatgctttgagacacggtcatgctaatgttattgaaattaaaatttatcaagaaaattcaaatttaataatttatattaaagataatggtttgggttgcaaagaagtaaaaaaaggttatggtttaaaacagatgcaagaaagagttgctattttaaatggtactttgaagtatgatggaaatgatggatttactgttgaagtagttattccaatgaaagaaggagaaaattatgattaaagttctaattgctgatgatcaagaattaattagagaatcattaaaaattgttttaaatacgcatgaagatatccaggttattgatacagctggagatggttttgcagtcttagatagtattaaaagaaatatgccggatgttattttgatggatattagaatgccacgaatggatggagtgtattgtactaaaacagttaaggaattgtatccagatatcaaaattattattttaacgacttttgatgatgatgaatttgtttttagtgctttgaaatttggtgctagtggttatcttttaaaaggagtatctatggaggggctgtatcaagctattaaaacggttatatctggtggggcaatgatcaatcctgatattgcaacaaaagtatttagattgttttcgaaaatggcaaatactaattatgcaattagtgttaatgataataatgttaataatttaagtaatgcggaatggaaagtgattcaacaagtaggatttggcttatcaaataaagaaatagcccagaaattgtatttatctgaaggaacagttagaaactatttaagctcaattttatcaaaattagaattacgggatcgaactcagcttgctatttgggctgttcaaacaggacagacaacaaggaatttagatcatgattaaagcaaatagagtaaaaatagttattttggttattttgataattggtggctttatatattataataatcaaaagagagttctgactattggtatttttgcgggaagtaattgggatgttcctacttttgattactataagatgattgatgaaacaattgctcgttttgaaaaagagcatccaaatgtagaagtaaaatatcaaagtggtattttgaaagaagattattcattatggttatcacagcagttattaaccggaaatgaaccgaatctgtatatgattttaaatgaagattttaattctttagcttctttaggagctttgaaaaatcttgatcaaataattaaaagtgatagtgattttgatgttgataaattttatcaaaatacacttgaaataggtaagtatcaaggtgttcaatatgcattaccatacgaagttaatccaactttaatgtttgtaaacaaaacattattagaaaaagaaggaatcagtttacctgaaaatgattggacattagatgatttttataatatttgtaaacaaataacaaaggatactgataacgatgggataattgatcaatacgggtattataattatacctggttagatgcaatttatgctggaggaataaatatatttaatgaaagtggaacttcatgtgatttaaataacactaaagtcaaagaagcaattcaatttattgaaaaaataaatttgcttaatcaaggattcaatgttacttcaaatgattttgatcaaggaaaagtagcttttgcgccaatgcaattttctcaatatcgtacttataaaccatatccataccgtgttagtaaattctcaacttttgaatgggatgtaattgaaatgccccagcagacagatgcttatttaacacaattatcatcgctgatgattggtctttcaacgagatcaagtaatggtgatttagcttggcagttattaaaagaatttacatataatgagacatcacagcaggatatttataaatatagtcaaggagtttcacctttaaaatctgtaactgaatctgaagatatattaaaattattagaagaagatacgatgggtgatagcaagattgatatgagtgtattgaataaagtaatggaatatcctacgatcaatacaggattcaaaaaatatgaagctgtaatgaggatagctaataatcagattacaagggctttgcaaagtaatgcagatcttgatactacattgattgcattacaaagagaaataaataattatttaaacgaatagcgactgctgttcgtttttattatgaaataaatatctttcaaacacgaatatgacatttgtcatattccgagtgacaaatgtccattaaaagtagtgacaatgctcagatgtatttaatgaagtaacttgataagatataagtgtcaaaagaaagggaggtcaaaaatgaaatacgtagtattagttagtcacggaaactttgctaaaggattattagattcattagaaatgttagcagggaaacgtgaagaagttattgcagttggattagaaaatgggattacagctgatcaatttgcaattgattttgctgaagcaattaaagtaattcctagtgatgctaaaattattttattagcagatttaattggtggatcaccattaacaactgcgatgagtgttttatcttcattaaatcaaatggataatacactagtattaggaggtatgaacttagcattagcattaactactgtattgatgaaagatacgttagatgatgatttacttgttgcctcagtaactagcgaagctactggtgcaatcaaacaatttgttctagaaacaaaagatgaagatgatgacatttaggaggaaagaaaatggcagttacttttgtaagaattgatgaccgtatgattcatggtcaaacttgtactagatgggcgcttgaatatccatgtgatggaattgtagcagttgatgacaatgctgctaataatccggttttaaaagctgcttataaagctgcaagtggaaaaaagacatttatttggacaatggcagattggaaaaagaaatgtcaaaaagtattagatagtaatgataattatttcttaattactaaaaatccattaacaatggaacaaattttagttgaacaaggttttgttcctagcgatgttaaaacagtaatcgtaggaccatgtaatgatcgtgaaggagctactaaattaggaaataatcaatcaattactcaagaagaagctgatgcattagaaaaaattatgcaaaaaggttattctgtagaatttgctttggtaaaagaagaagcaattggaaattggactaaatttagaggacaattcggttataaataaaagaaaaggggattaatattatggaaataagttggttacaagcagcgattttaggaatctttgcatgtttatcaagtatgcctggtcttgggggtacatcacttggtaactatacattaggtagacctttagttgctgggttagtatgtggaattgttttaggggatgttacaactggggttattgttggtacagcgatgcaagttctttatatcgctttagtaacacctggaggaacagtatctgccgatgttcgtgcagtaagttatattggtattcctttaacaatggtattcttaaaagcaggtggaattgatcctgctagttcagatggtttagcagctgctcaagctttaggagcattagttggtacagttggtacagtattattctatggtacagctactatgaacttattatggcaacatattgggtggaaagctgtagaaaaaggtgaatttaaaaaattatatgcagtagatatggttttaccttggatttctcatatcgtttgttcattcttaccagcattagttatgtgtaaattagggcaacctatggttgaagcaattcaaacatatttaccaatggatggtattgctatgaaaacattattcacagttggatctttacttccagcagttggggttgcaattttattaaaacaagtagctaattcattagttgatttcgtttatttcttctttggatttgctttatcagcagctttaggtttaaacttagttgtagctactgtaatcggtggagtatttgccgtaattaattacaaaattaagatgattagtattgaagccaaagcagctgcagcagctggtggtttggatgatgatgacgaggaggatatttaagatgaagaaaatatctaagaaaacattaaataaatcatttagaaactggtattatggaaatttaacttgtttctcacaagaacacatgcaaacatttggttacttagtatcaatgttaccaattgttgaagaattatatgatactaaagaagaacaaaaagaagcaatgaaaacatatactgctttctttaatacagaaccacaagttggagcattgatcgttggtgttactgctggtttagaagaatcaaaagctaacggtgaaccaatcgatagtgaaacaatcaacggtttaagagctggtttgatgggaccagtagccggaattggggactcattagtagttggtactttaattccaatcttacttggaattgggatgggattagctacaggtggtaatccaattggtcctatcttctatataattgcttggaatatcttaattacatttggaatgaaattcctttataataaaggatatgaaatgggtggtaaagctgttgaattcttagttggtgaacaagctaatgccattcgtgattcaatcgtattattaggtacagtagtaattggtgctgtagctggagcatgggttaatatctctacttcatttacaatgactgctagtggtgccgaaaaaccattcttagttttaaatgattcattaaattcagtatatccaaatttcttatctggagcatttgtaattttatgctggtggttaatgactaagaaaaaattagcacctactacagtaatgttgattttagttgtaattgcatttgtaggggtattagtcggattctttgatccacaactttcatattaaaattcaggaggactattatgaatcaaaaattaaaagaagcatatgttgaagaagtaaaatatcaaaccaaacaaattaatcgtttaaaaatatggttaagaaatttaataattatctcctcccttataataattatcattttctttgctaaaagtagttcaatcattacaataatttcatattttgctttagtggtaacaataatagctttattaactactggtttagcgattcgtaatggttcaatgaatgtaaaaaatatcttgaataaaatagaaaattcataagaaagtacaacaagtctataagtaagagattgagcgatgctcgatctcttttttgttatatgatttaaaatgtaatacaataatattacaaatgtcatataaattgattacatttgacaattaattatttacaataaaataattataatattcatataaatcacagaaaggggatagagatgaaagctaaaaagattttaagctcattgttaattttatcaatgctattcactaatttaacaattgttaatgctgctggtggcgatgatgaaaaaataagtgttcctgaaggaacatttgtcagcaatggtagtgatgaaaagaattttgttactaacctagaaggcgttgaagaaaatagcaattggcaaaaaagtgatattggaatcacaggaatttccgatggggattcatttttattgagtgaatctgagggagacaatttcgtttatgaagctgatgttaagtttaatgaacgaaaaggagctgcatctttagtatttagagcaagtgatgatctaaatactaaaaatatgtatgtagctaatgtaaatggtgaaacaggtgaagccagattatttaaatttgaaaaaaatgatgttgtagatttaggtaaatctagttatatttcattaactgaaaataacgaatatcatttaaaagttactgttattgataaacatatggtttattatatcaacggtgagttagttatgaatactgctgactatacgatgaatactagtagcagtgattctcattatggtcaaaacgatgtaatcagtgaaggtttatttggtttacttacttggaatggtaatgtaacttatcaaaatgttgaatacactcctattactgctgacaattcaccaagattaacaggtttaacgattgcaagcaatgatggtaaagttgataaagatatccaatttgcaagtggtcaatatgtttatattacttatgttagtaatgcaacaacatcagtaaaattattacctgaaattggtaatgacagcataattactgctagcgatgaagatggtaatcttgttgatatcaacaatttaccagtaacaaaagatttacaaacatatactttaacagtaagaaatggtgatgctaaagtactttatcgagttcgtgtacatcgccaacaaccagatgaagtatattacaacgaagattatcgtggtcaataccactattcagtaaaagatggatgggctaacgatccaaacggaatggtattttataatggtgaatatcatttattctatcaatattatgacagtgataaatggggaccaatgcactgggctcatgcaactagtacagatttaattcactgggaagaacatccaattgaattctatccagatgaatatggaacaatgtattcaggatgtgcagtaattgcaaatcatgaaacagcacctgaagtttttgctgaaggtgaagaaggaatcttcttctttatcacagctaatggtacaaatggttctgatggacaaagaattattggtgcctatagtaaagatggaaagacattccataaatatgatgaaggaaaagtattattagactggaaagatgatccactatataatacagcctttagagatccaaaagtatttagatatgaaaataaatggttcatggtagtagcagggggaccattaagaatctattcatcagatgatttaatcaactggaatattgaatcaacatatccagatttaaatacagaatgtccagatttatatccaatagaagtaacaaacgaaaatggagaaaagactggagaagtaaaatgggtattagatcgtggaggtcgtttatacaagatcggtgactttaaacaagtagatggtaaatggacatatattccagaagaacaatatgcaagtacaaatgcaaatggtatgggtaatgatgtcaatgacggtatcatgaattttggaatggattcatatgcagctatgacttattatcaaggtgattttggaacagctgatgaatttataggtcatgatatcattgcaatcaactggatgaatacatgggatagtagtttctgtaatacaattcctgatgttaatggtaatactgcttttaatggaacatttaatttacagttaaaattaggtgtaacaaaagatagtgaaggtaactattacttaactcaaacaccaattaagcaatataacgatttacgtgatacagaaaatgcagtagtattaaaaaatgaaacaatcaatgaaaacaatgaattattaagcagttttagtggtgacagttatgaaatcgttgctaatttaaaacctgatgctaacagcacagaagtagggtttaaagtaagaacaggtgatgatcaggaaactgttatcaaatatgatattgcaaataatttattaacaatggatcgaactaaatcaggaattttgattctaaatgatgaaagaatcaatgtaaacagtcaagcagtgactagaaatgctgatggttcaatcgatttacatatttatgtagaccgcagcagtgtagaagtatttacaaaagattatactgtagctggagcaatgcagatcttcgctagtccagtaagccagggattaagtgtatacagtaaaggtggtaacacaactggaaatatcactgtatatccattgaattcaatctgggataagatcacaccaacatcaccaatagcagtaggacttgataaaacaagttttaacggttatgtaggagatgaattcacattaaatggttgggtatcaccaagtgaagtatcacaagatatcgtatacagtgttgataacgatagtgttgtttcattagtacaagatggaaacaaagctacgataacagcattaagcagtggaacagcaatcgtaactgctgcatcagcaacagatccaagcgtaaaaaaagaatgtgtggttcaagttcgtgaaaacaatttcaaaacaaatttaagtgattttacagcagtatcaggaaactggtatattgatggagaatcatattatggaagtcatagtgataatgccttcttatttgcaaacaaattggatacagatgaatttaaatatgaaatcgatgcaacatatgaaacaggtattttaaatttcattttccaatcacaaacaacaaatgtttgggatggaagttatgcattacaattaaacggaaatacagtaagattatttgatttcaaaggtgattatacatttacaagtacagatacattagtaagaccagaagataaccaatatcacattgaaatcaatgttaaaggaaataacatagtagcaacagttaatggtgtagaatatatcaattatgaagttacagaagcagatcgtcaatatagcaatggatatgtaggattaggattatataatgctacagctagctatcaaaacttctatgtaacaactgatacaccagtaactaagattactactaagattgatgatttaactccagcaatcaatgcaagcttagaagatatcaaatcattattaccacaaacagtaactgttgctggtgatgataatcttgataaaaaagatcctgtagctattgattgggacttaagtgcagttgatgtaaatacaccaggtacttatgtaattacaggaactatcgatggtggtattacaacaacagttaatgtaacaattcgtacaaatgtttggctaactgctctagctagcaaagaatatagtcaagcagattatacagttttaagttatcaaaattatttagaagctcttgtagcagcaaatgatgttcttgcaaatgcaaatgcatcacaagatgaaattgatcaagctacagttaaattaaacgtagcaatcttaagtttagtatctatcaaagacttaaatgaagcagtaaataaatatcaaggtttagatgaaggattatatactagcgaaacttatcaagcatacttagatgctttgaataatgctaaaactgtattagctaaagaagacgctactcaaagtgaagttgatgaagcattagcatcattaaatcaagcagttgaaagtttagttaaagttgaagcagatccaaaaccaggtgatacacaaaaacctactaaccctcaaaaaccatcagtaccaactggtgatgagtttgatattagtggttatgctatattattaggtttaacagttgtaggactaggtttattaaagaaaaaaagagttttaaataaataatctgaaattagagttagtactctatattaggtaatcaaaaagagatttcaaaactatttattagtataagaaatctctttttttagtaaaaaaacctaaataactttttttccaacaaaaaattgttacttttgtcatataaaataaattacatttgacccgtaataaataatgatcaaatgaagtatactatttacataaattgtaaagaaaggggattataatgaagataggtaaaaaattactaagttcagtattagttttatcaatgctatttacaaatttagttattgttaatgctgataatgtaatgagtgatgaaaagattcgtgtacctgagggaacttttgaaagaaaatcagaaattttaagtgattttgtttccaaaagtaatggtacggtcactaaaggagatgatggtgtcaccttaagtaaaaataatgatggagatcatcatgctttattaaaagatggggagatatataaaagctttatttatgaagctgatgttaaaattattgatgggataagtgctggattagttattggagtagataatccagacaacgtatctagtttttggtatgcagttaattttaatactaatggagatgctgattttgctcgattatttaaagttgcaggcgatgttactaattatacatgtatttcaaaagacgaagcaacttctaaaattgattttactcagacagttcatatgtatgttgaagttgatgaaaatggaaattttatttataaattatcagatgctaataatcaaaatgttattaaaagaaccggaacaattgataactggaatggtggatatattggtttattaacatttgatagtgaagcaaaatttagtaatattaaattcacagatactagcagtaaaaattttgaaactgatttaacaggtatcgaggaaaataattattggaaaatcggtgatattggaatcactggtatttctgatgaaggtgcagattcatttttattgagtaaatctactggcgataatttcgtttatgaagctgatgttaagtttaatgaacgaaaaggagcggcttctttagtgtttagagcaagtgatgatctagaaactaaaaatatgtatgtagctaatgtaaatggtgaaacaggtgaagccagattatttaaatttgaaaataatgctgccattgatttaggcaaatctaaatatatttcattaaccgataataatgaatatcatttaaaagttactgttatcgataaacatatggtttattatatcaacggtgagttagttatgaacactgctgattatacgatgaatacaagtaatgatgattctcattatggtcaaaatgatgtgatcagttctggtgaatttggtttacttacttggaatggtaatgtaacttatcaaaatgttgaatatactgctattactgttgacaattcaccacaattaacagatttaacgattgaaagcaatgatggtaaagttgataaacagatccaatttgcaagtggtcaatatgtttatattacttatgttagtaatgcaacaacatcagtaaaattatcacctgtaattggtaatgacagtataattactgctactgatgaagatggtaaaactgttgatatcaacaatttaccagtaacaaaagatttacaaacatatactttaacggtaagaaatggtgatgctaaagtactttatcgggttcgtgtacatcgccaacaaccagatgaaacgtattacaatgaagattatcgtggtcaataccattattcagtaaaagacggatgggctaacgatccaaacggaatggtatattttaatggtgaatatcatttattctatcaatattatgacagtgataaatggggaccaatgcactgggctcatgcaacaagtacagatttaattcactgggaagaacatccaattgaattctatccagatgaatatggaacaatgtattcaggatgtgcagtaattgcagatcatgaaacagcaccagctatttttgatgaaaatcaagaaggaattgttttctttatcacagctaacggtacaaatggtgccgatggacaaagagttattgctgcctacagtaaagatggaaagacattccaaaaatatgatgaaggaaaagtattattagactggaaagatgatccactatataatacagcctttagagatccaaaagtatttagatatgaaaataaatggttcatggttattgcaggaggaccattaagaatctattcatctactaatcttgttgactggaagattgaatcaacatatggagatttacatacagaatgtccagatctatatccattgacagtaacagatgaaaatggaaaagacactggagaagtaaaatgggtattagaccgtggtggtcgtaaatataagatcggtgactttaaacaagtagatggtaaatggacatatattccagattctcaatatgcaagtccaaatgcaaatggtatgggtaatgaggataatgatggtatcatgaattttggaatggattcatatgcagctatgacttattacaaaggggattttggaacagctgatagttttaaagctcaagatatcattgctatcaactggatgaatacatgggaagcaggattctgtaacgcaattccagatgctaatggtaatactgtgttcaatggaacatttaatttacagttagaattaggtgtaagaaaagacagtgaaggtaagtattatttaactcaaacaccaattgatgcatatcaagaattacgtgatgaagcaaataaagtagaattaaaagatgcaacaatcaatgaaaacaatgaattattaagtgactttagtggtgacagttatgaaatagttgctaatttaagacctgatacaaacagtacggaagtaggatttaaagtaagaacaggtgataatcaggaaactgttattaaatatgatttaacaaataatttattaacaatggatcgtcgtcaatcaggcgtaacagtagttaatgaagatcgtatcaacgtaaatagtcaatcagtaactaaaaatgctgatggttcaatcgatttacatatttatgtagaccgcagcagtgtagaagtatttacaaaagattatacagtagctggagcaatgcaaatttttgctagtccagtaagccagggattgagtgtatacagtaaaggcggtaatacaactggagatatcacagtgtatccattgaaatcaatctggacagataagatcactccaacaaaaccaactgcagtagggcttgataaaacaaacgttaacgcttatgtaggtgatgaattcacattaaatggttgggtatcaccaattgaagtatcacaagatatcgtatacagtgtagataacgatggtgtgatttcattagaacaagatggaagtcaagctaagataacagcattaagcagtggaacagtaactgtaactgctgcatcagtaaaagatccgagcattaaaaaagaatgtgtgattcaaattcgtgaaaacaacttcaaaacaaatttaacagattttacagcggtatcaggaaactggtatattgatggggaatcatattatggaagtcataatgataatgcattcttatttgcaaataaattggaaacaaatgaatttaaatatgaaatcgatgcaacatatgaatcaggtattttaaatttcatcttccagtcacaaacaacaaatgtttgggatggatgttatgcgttacaattaaacggaaatatagtaagattatttgatttcaaaggtgatcatacatttgaagagaaaaatacattagaaaaaccagaagataaccaatatcatattgaaatcaatgtcaaaggaaataacatagtagcaacggttaatggtgtagaatatatcaattatgaagttacagatacagatcgtcaatataatgaaggatatgtaggattaggattatataatgctgcagctagctatcaaaacttctatgttgttactgatgagttaaaagtatcagtatttaatggtgaaagtgataaagctgaatatacttattatgacagtagagcaactgctacagttactgctgaacaagtaataggaaaaaaattcttatattgggtcaatgaatatgatagaatcatttcgtataaagatacttattcatttattgtcgttaacaatactgttttaaaagctgtatatggtacagatgatacaaccgtagaaaaagtgccatctattgttatggatccaaactgcactataactacggtagatggtaaatatcgtttaagttttaatggaaaattattcttgccagaagattataaattagtagaatttgggatgttatttacaccagtagcagaaccagataaaaatggatttgttattggtggtagtgtaacgccaatgcaaaaactagtggtcacaagcaaaaatagtgaaggacaatatgtagttaacattaataatgttaaagctggagttgcacgaagcggtagaatgtatatgacatataaagatgctgctggcaatacaacaacaatatatagcgaggaaatttctaaaactggaattttacctgcaattaattaaagataggagctgtttaaatgaaagaaacttatgaaacacctttggttgaaatagtgaagtttgaaaatgatgatattattactactagtagtatagacaatgattttaatgatgaagattttggttgggattagattcatatattagttatagaatgagaagcagttctcattctttttgtttggaaaatataagggaaaaagtattgctttattatttgacaggatatttattattaagtaacatagttgcaatggaggtgtggtatgttactaataaataagacgttgataaaaatgtccaagggaattagaggttggattgttgtaataacgggtttaaagatattgacattagtgggtacggttatgtttgctaaaacattggcatcttttttaggtgatttgtataatccagctttgacaaaagatgatttaattggtgccatcattagtactttaattgcttctgtcttgattttggtagctgatttattgacgggggaagcgcaatatcgtttagaggctaaagcgagagttcgattacgtcaggagatatttaataagatgttagagctggatgttggtaaaattgaacagatcggtgctagtaatacaattagtgtaattggtgatggagtggaatcgatgcaggtctattatacaaagtatatgcctagtcttttgtattgtttttttgcacctgtttacttgttttttcaattaaaggatacttcattattgatagctagtatcttattggttatttctttattattgccgttattaaataattattttaggcagacaatagataggttgaaaaaagcgtattggacaagttttcaggatttaacaagttattatcttgaaagtttaaaaagtttagttactttaaaattgtttaatcaagatgatagacggtatcgatcattaaaggaaaaagctgatgattttaatgttaatacgatttcaatcatgaaaataaattttgtttcatttttagtgtctgatggattgatttatttaggaatcgttatagcggtaatcgttgcttgtttgcaattagataatggcacgattgatttatcgaaagcagtcttgattttaatgctgtcatatagcttttttgcttcaatcagacaattgatgagtgcggctcatgatgctttgacaggaattgcagcaactagtaaagttgatgagatcttaagtttggatacatcaagaaaacagttatcaatcgttgaaagtgatgaaaaaatcaaaacagaatatgatcaggaaactttaacttatttacgtaactatcagggaattataatcaaagatgttgattttagttatgatcatagacgagcaatattgaagaatttaaatattgaaattcttcaggataagataacagcaatcgttggtaaaagcggttgtggtaaaagtacggttgcaaatatgctaatgcgttttattgatccggatactggttatttgtattttgaagggacatgttattataatgaaagtcctgaagtgcttagaaaaaagattatcatggtgccacaaaaagtaagtatttttagtggtagtcttgaggaaaatctaaaaatcgctaaaatagatgctccaacttctgaattaatagatgtattaaaacaggttaatttatatgactggttaaaatctttacctgaaggctcgtcgacagatctaggtgatagcggcgctaaactttcaggtggtcaaaaacagaagatcgggattgcatgcgccttgttaagtggggcgccttatatagtttttgatgaggcaacttctagtgttgatcaaaatagtgaagatgaaatctggcaatgtatcaatagattaagtcatacgagaactttgatcattatttctcatcgtctatcaacgattcaacgagctgattaaatcattgtcttgaatcaaggagttttagttgaacagggcagtcatgaagtgttgttgcaaaataaaggtgagtattatcagttagtcaaagaacaggaaatcttagaatcacatggaaagaagaggttgaattatgaatcgtaagcaatcattatttactcttactaaacggttgttgaagattgcttcaacaatgaaaaaatattttattatttcaacgatcgtcagcattttaggaaatgctgcgcaaatgggattaatggggtttggagctggttttattttgagtgttgctggtaaactgtcgctaaatcgtaatctttattgtggcttgatgatcatcagcgctgttttaattgtcgtgtgtcgctatttagaaggttatttttctcatgtgggagcctatgaactgcttgctaaaatgcgcattgatatgtttggtcgattaaaagcattggcaccagcggggttgattgattatactagtggcgatatcatgtctcgggcgatgtcagatattgaaagtatcgagttcttctttgctcatacgatcggacctttgtttaccgttattttattaccagtaattactttagtaattgcaggaaacattgatatgttatttgtatatggtttattaccgatatatctgatcgtgagccttgttattccctttttagcgataaagttaggacgaaatatcggtattagctatcgctttaaattaggtaagttaaaaacttttttattagatagtgtatatggtttaccagaaattcaaatttttgattatggtaaaagaagaacagaagaattgaaaaatgtcaatcaggatatcaatcagacgactcataaactagcttatcatcggcagctggttatttctacaccatcgttttttatatatttagcacgaatcatggtcattgcgattgcttcgtatttaactttgcaaggtgagcagaatataaccgcgattattattttatcgtttgttgtttcggcatcgttttcttcgactcagtctttaacaactgtcgtatctagtttgttggagacatatgcggcaagtcaacgtatctttgatttagaagatgcattgcctttagttacagaagctgctgattctaaaaaactggaaagaatagataaaattgagtttgttgatgttacatttaagtatcctaaaactaataagacgattgttgaaaaaatgaacttagttattaatgttaaagataaaattggtttgattggtcaaagtggaattggtaaatcaacattaattaggttattattgcgtttttatgatgttgatgaaggaatgatattgatcaatggaattaatattaaagaatattctcttagagatttaagaatgcgtattggaactttagaacaagagacatttatttttagtgatacgattgctaataatattgctttagctaaacctaaagcgagtaaagaggaaataatcaaggctgctaaaatggcagggattcatgacttgattatttcgttacctgatcaatatgatacagtaatgacagaaatgcaaaatcgtttatctggtggtgaaaaacagcgcatcggaattgcgcgagtgctgttagctgatcctgattttttagtaatggatgaaccaacaagtagtttagatgttattaatgaaaagggtttattaaaaacgcttgatgaacgatttaaagataaaacgtggttgattgtttcacatcgaccttcatcacttacagattgtaatcgaatcattagtttagaaaataagcaaattaaagaattagaaggaaaagcataaggcttttccttttaattatgatagaataagaatgaggtgaaattaatgaaagaaagtatgaagtttttgacaaatcattatcaattaagagaatttgttttaattagaatgttagaaatcattgaacaaactaaaacggcgcaaaagggtggagtagttttttttggtgattcgattacacaattttgtgatttagataaattttattttgaaatagataataagtataattgtggaattgcgggaataacttcaaaaatattattaaattttattgatgaaagtgtaatcaaatatcgtcccagcaaagtagttattatgattggaacaaatgatttaggtaatactgtaatggaaagtcctagagacatcgctttaaatgtaaaagaaatgattgaaattattcattataattgtctggatgctaaaatatatcttgtttcagcacttccttgtttagaaaaatatcatggctataaagcagaaaaacaagggatgcgaagtaatgatatattaaaaatgatttttaaagaatataaaaacgttattccttatgaatacgttactttcatcaatgcttatagttcaatttgtaataaaaaaggagaaccgattgaagaatactatgtcgatggtttacatatcaatgaaaaaggttatgaaaaatatacggagtttattaaaaaaagtttattgaaatagaaaaatgacttaataatatataaatgatataataggtttaaaattaagatatattttatatgcgaaaaagttattttcacattagtatcgtataagtacaattttcgcacattttaatgaaatgaggtgagaaaatgggaatatacttaaatccaggaaattatggttttaaagaagcagtcaacagtgaaatctatgtcgataaatcattactgatagaatataccaaccggataatcaatacgaatatgaaaaacatctgtgtatcgagaccaagaagatttggaaagagtactgatgccaggatgatagcagcatattatgatcaaagctgtgattcatcaaaactgttcaaagatctaaagatagctaagagtaaggaatatcaaaagcatttgaataagtacaatgtgatcttattaaatatgcaggattttttgagtgaaacaaataatattgatgagatgattgggttaataaaaaacagggtacttagagatttgaagttaggatatttggaatatgtggaggaagataatttaagctattctttaaataatatttttgcatatacaaaagaaagctttatttttatcatcgatgaatgggactgtatctttagagaatatcagggagataaaaaagctcaggagaaatatctggattttttaagaaatctgttgaaagataagccatatatatcattatgttatatgacgggaatcctgccaatcaagaaatatggaacccatagtgctttgaatatgttcaaggaaatatcgatcctcaatcccaccccactggaagagttcatgggatttacagaaaaagaagtacaagatttatgtttaaaatatgatatggactatgaaaaaatgaaagactggtatgatggatataaaatgacagatgatttatcagtttataaccatcgttctgttgtttatgctttgatggacagaaaatatgaaaactactggagtgcaaccgaaacgtatgaagcattaagagtatatatcgatatgaattatgatggcttaaaagatgatatcgtgaagttgttggcaggtgaacatgtcgctgtacagacgacatcatttcaaaatgatatgacgacgttcaaatcaaaagatgatgtcttgacactgctgatccatctaggttatctaggatataacagttccaatcagacatgttatataccaaataaagaagttatcgattcatttgttaattctataagaagttctaactggaatgaaataacgaaggcgttattaaacagtcgcgccttattagaagcaacatggaatagagatgaagaattagtagctaagtatatcgaagaagcgcatctggatacagcgatactaacatataataatgaaaatgcgttatcctatacaatttcgattgcgtatatgtatgcaagaaatcattatacgataataagagagatgccaagtgggaaaggatatgcggatatggtgtttattcctaaagatgataaaccagcgatgatagtagagttaaaatgggatcatgaagcagaaacagcgatagatcaaatcaaagaaaagaaatattattgtggattagagaaatatctggatgagctattattagtaggaatcagttataataaagagactaaagaacacagctgtataattgaaagatatagataaaggaggtggaaaaatgggaatatacttgaatccagggaatacagagtttcaaagagcactcaacagtgagatctatgtcgataaatcattactgatagaatatactaaccggataatcaatacgaatatgcaaaacatctgtgtatcgagaccaagaaggtttggaaagagtactgatgccaggatgatagcagcatattatgatcaaagctgtgattcatcgaaactgttcaaagatctaaagatagctaaaaataaagaatatcaaaagcatttgaataaatacaatgtgatcttattaaatatgcagagttttttaagtaagacaaataatattgaaaaaatgttagaattattgactaggctgttagttcgtgaaataaaaatggagtatttaaaattagatttatttgatgaaacgaatttatcattaactttagatgacgtttatatacagataaagcaatcattcatcattatcatcgatgaatgggactgtatctttagagagtatcagggagataaaaaagctcaggaaaaatatttggattttttaagagacttgttgaaagataaaccatatgtatcattgtgttatatgaccggaattctgccaatcaagaaatacggaacccatagtgccttgaatatgtttaaggaagtatcaatgatcaaccctaccccattagaagcttttatgggatttactgataaagaagtagaagagttatgcaaagaatatgacattgaatataaagagatgaaaacgtggtatgacggttatcatttaagtaaagaggtatcagtatataaccctcgatcagtagtatatgcaatcatggacaggaaatttagtaactactggacgagtacagaaacatatgaagccttgaagatatatattgatatgaactatgatggtttgaaagatgatgtcattaggttgctcagttacgaacgggtagctataaatcctaataagtttcaaaatgatatgacaacatttgcttcaaaagatgatattttaacactgttggtacatctaggatacctgggatacgataatataaataaagaagtatatattccaaataatgaagtcataagttcatttattgattcaattgaatcatccaactggaaagaaacgacaagagcgatactaaacagtagagccttattggaagcgacgataaatcaggacagcgaagcagtagctaagtatatcgaagaagcccatctggaaacatcgatactgcagtataatgatgaaaacgccttagcctatacgatatatctcggatatatcacagcccgaaatgaatatacgctgataagagagatgccaagtggaaaaggttatgcagatatcgtattcatacctaaaaagaataaaccggcgatgatagtagaattaaaatggaatcatgaagcaaagaccgcaatagatcaaatcaaagaaaagaaatattattgtggattagagaaatatctggatgagctattattagtaggaatcagttataataaagagactaaagaacacagctgtataattgaaagatatagataaaggaggtggaaaaatggggatatacttaaatccaggaaattatggttttaaagaagcagtcaacagtgaaatctatgtcgataaatcattactgatagaatataccaaccggataatcaatacgaatatgaaaaacatctgtgtatcgagaccaagaagatttggaaagagtactgatgccaggatgatagcagcatattatgatcaaagctgtgattcatcgaaactgttcaaagatctaaagatagctaagagtaaggaatatcaaaagcatttgaataaatacaatgtgatcttattaaatatgcaagattttttgagtgaaacaaataatattgatgagatgattgggttaataaaaaacagggtccttagagatttgaagttaggatatttggaatatgtggagaaagataatttaagctattctttgaataatatttttgcatatacaaaagaaagctttatttttatcatcgatgaatgggactgtatctttagagaatatcagggagataaaaaagctcaggagaaatatctggattttttaagaaatctgttgaaagataagccatatatatcattatgttatatgacgggaatcctgccaatcaagaaatatggaacccatagtgctttgaatatgttcaaggaaatatcgatcctcaatcccaccccactggaagagttcatgggatttacagaaaaagaagtacaagatttatgtttaaaatatgatatggactatgaaaaaatgaaagactggtatgatggatataaaatgacagatgatttatcagtttataaccatcgttctgttgtttatgctttaatggacagaaaatacgaaaactactggagtgcaaccgagacatatgaagccctaagagtgtatatcgatatgaattatgatggcttgaaagatgatgttgtcaaattattggctggagaagaagtatatttgaatacagataagtttcaaaatgatatgacgacgttcaaatcaaaagatgatgtcttgacactgctgatacatctaggttatctaggatataacagttccaatcagacatgttatataccaaataaggaagtaaccagttcatttatagcatcgattgaagattcatcatggaatgaaacaacgaaggcgttattaaacagcagagccttattagaagcaacatggaatagagatgaagaattagtagctaagtatatcgaagaagcgcatctggatacagcgatactaacatataataatgaaaatgcgttatcctatacaatttcgattgcgtatatgtatgcaagaaatcattatacgataataagagagatgccaagtggcaaaggctatgcggatatggtatttattcctaaagatgataaaccagcgatgatagtagagttaaaatgggatcatgaagcagaaacagcgatagatcaaatcagggaaaagaaatatccaaagggattggaaaaatatagagataatttactattagtagcaataagttatgataagaagacaaagaaacatagttgtgtgattgaaaaatataaataaaaagccaattgtttttggctttttataatattttaccagttccaccgcaatagtaagtgataacagtaattaattctccagcgacatttttaacatagttatagtcagttttttcgtttccttgcacaataaagaaaatatctttagaatcattagtaactttagttttattgacttgacgaacttcaaggtaacagatgatttcattgttatcatcaatatagctgtatacattagcaggaacttctttgggttcctcttgaccaaggggaatgaataattccttgccatctgttaattttaaacttacattaccagtaattttatcaatatcatgggcacctaaggctaatttagattccatggaaataatattataaatatcaacaacaggattgattcttgtaatatcatgacgtttttttaataatttaattaagttttcactggcaggtatatttttacgtttagaaacacctatttttttatgtaagtcataaaaaccttgaataattggatcgtttacatctgatgatttaagtagtctttgactgtgaatatttaaataatcattgagactatcactataatgatgattatttattcctgtaatacgcacgccgatacattttatacccaaatcttttactgcttgttcaactgtgaattccatatatatatccctcttttcctatctttatagtatgattaaaatatatatcaaaataatagttttttcaagcaaaatgttaacgtgctattttattaatacttgtgtataatatagacgaggtgagaaaatggcaaaaatattaattattgaagatgaagaaaaacttcgtgatgaattaaaagtttacttaaagaataatggctatatagtagaagtaattacctcttttgaaaaaacattagataagatgatttcttttgatggtgatttgattttattggatatcaacttacctaatgttaatggacagtttttatgtaaagaatatcgaaaaaattcatcaaaaccaatcatcattgtaacaagccgtaataatgaaatggatgaattgatctgtataaattatggtgctgatgattttgttactaagccttataatcccttgattttattagctaggattgaagctgttttaaaaagaactaaagcagcttatgataatatgcttagttatcgagatattaaattagatgtatcaaagagtttaattataaaaaatgaacaaacaattgaattatctaaaaacgaattaaagattttatattttcttttaactaatcgtggtcaaattaaatctcgtgaagaaatcatgacttatttatgggatagcgacatgtttgtagatgataatactttgacagtcaatataaatcgtttgcgtaaaaaattagaagatattggattaaaagatgtaattcatactagaaggaaacagggctatataattttatgaaattaaatgattatttaaaaaatcaaataattaatattacgattgccttttttacgattgctttggtatgggttattttgtgggcttttaactgtccaaggtttttagttttttatgtgccgtttttaattttaatttcatttagtttgatttgtgggtatgatttttggcgaaaaaggaattattataatcgctttattcaatgtttaagtgagctggatgaaaaatatttaattactgaattgattgaagagccgcatttcattgaaggaaaaataatggttgatagcatttatgagatagataaagcgatgaaagagcatcttaacaaatcgttgttttgtcaaagtgagttaaaagaatatatagaaatgtggtgtcatgaggtgaagacaccagtagcaacgagtcagatgattattgaaaataataaaaatgaaataaatgatagtattaaagaagaattggtcaagatcgatgattatgttgaacaagttcttttttatgcgcgaagtgaaaatgttgaaaaagattatttgatcaaagaggtttgtttacaggatgttgtaaatacagttattaaaaggaataagaaagatttaattagtaaaaaaatcaggattgatttagatgatctaaatatagttatacctagtgataaaaaatggctagaatttattttgcatcagattattaataatgcaatcaaatatagtcaaaaccagccttttattcatatctatgctcaaaaatataaagatcatgttgaattaatgattcaggataatggaattggaattctagaaagtgaaattgaccgtgtttttgataaaggttttactggtagtaatgggcgtaattttaaaaagagtacgggaattggcttgtatttatgtaaaaaattatgtttgcgtttaaatcatcaaatcaagattgcttcaagtcatggaaatacagtagtgacgataatatttcctaataattcttacataaccttacattaatgtaaggttatgttattttattcgatggaagaaaaatatgtaatagatataatagttattgaggtgaagataaatggaaaaaatattaagaattgaaagtattgagaaatattatggtaataaaagcaatcttactaaagccgtagataatattacttttgatgttgatgatggcgagtttttagcaatcatgggcgctagtggtagtgggaagagtacgttattgaactgtatttcaactattgatagggtcactagtggccatatttatttacgaaatgaagatattacgaaattaaagggcaataaattaactaaatttagaagggattcactaggttttatttttcaagattttaacttactggatactttaacatcatttgaaaatattgctttagcattaacgattcaaaaaactaattataaattaatcgatcaaaaagttattcaggttgccaaagcattaggaattgaagaaattcttaacaaatatccatatgaactatcaggtggtcaaaaacaaagagtagcctgtgctagagcaatcgttactgatccagatttgattttagcggatgaaccaacaggtgctttagatagtaaatcagcaagaatgctgttagatagtttaaatgtattaaattcaaaattaaatgcaacaatagtcatggttactcatgatccatttacagctagttatgctgatcgggttatttttattaaagatgggaaaatttttaatgaaataattcgtggtgaaaattcacgtaaagtattcttcaatagtattatggaagttcagacattattaggtggtgagctaaatgaagttatttaatttagcgtttaaaaatattaagaagagtattaaagattattcaatttattttttgactttggttattgcggttgctatcttttatatttttaattcaattgatagtcagacagcaatgatgtctcttaataaatcaaagatggatatgattgaatcattagtagatattttaagttatttatccgtttttgtttctgttgttttaggttttttaattgtttatgccaataactttttaattaagcgacgaaaaaaagaaattgggatatattttactttgggaatgtctcgagcaaaagtttcattgatcttagttttagaaacaatgatcgttggaattgtttcgttgataattggattgatcttaggcgtcgttttatcacagctgatctcaatatttactgctaaattatttgaagctgatatgactaaattcgcatttgttttttcaagtgatgctttattatatgcgattgttaattttggaataatctatttgattgtgatggttttcaatattatgactttaggtcgatttaaattgattgatctattatatgcaaatagacgaaatgaaaaagttaagataaaaaatagctgggtaatttttggaatatttattatctcgatagcgatgatcggttatgcttataaaatcttatatgatggtgtaatgatgtcgggtggctcagactttttagtgatgattattttaggagcactaggaacgtttctatttttcctatcagtagctggatttttattgaaagtagtacagttaagaaaaaagacatattataaaggattaaacatctttattttaaagcaggtcaataataaagttaatactcatgttgtttcgacgacggtaatatcattgatgctgcttttaacgatcggaattttgtcttcatcattatcaatggcaaatgccatgaatgattcatatcgagacaactgtccaaatgattttacagtattaagtagtcaagttgataaattaaaagattttagaaatagtaaaacttatcaagataccataaaggatgattatcagtttagttttattaaactagaaggcataacgcaaggtgatttcatcgctgcaaaaagcgataaatatgccaatatggaatatgtgggaaggcagccaatgcaggttattaaggaaagtgactataatcagattttaacgattcaaggaaaagatgaacagatagttgatcttggtgataatcaatatcagttagttgctactcttccgatggctttagagttttataatgaatttcttgaaggtaataatgcggttaaactagataatatgactttaactagcaagactaaaaaggttgttgaattatcgatcatcaatggtgaaggtaatgaaggatttattgttgtaaatgatgcgatagctgaaaaatatggtagtgagatggatggtattaataattatatcgtaggtaattatactcaaaataatgaaacttatgaaaataagtttatcgaatcgatcgatcagtttaatcaggataatcaaggaaaatatatagtctcatttacacggattcaaatgagtgattcagcgattggtactagtgcattatttacttttattggattgtatttaggaattgtttttgctattagtagtggtacagttttagcgatagaacaattatcagaatcttctgataataaagaaagatatcgggtcttaggacaattaggtgctagtagaccaatgataaatcgcagtctgctttatcaaattggaattacttttgtttttcctttggttgtagctttgattcatagttttgtagctttaaatgagataagttatattattaatctaatggtaagtattaatattgctgataaaattttaattactagtatttttattgtaattgtttatggtggatattatttagcgacatatcttgctagtaatcgaatcattaatgaaagatgatcagaaggtagaaaaggaggtttcgatgttgaaatctctttttcatattttgatgatataaatatgaagcagctttactttagatatttaaattgttactattgataaggggtgcgataatgaaaagaaaagaaccagtaattagtaatttagaagaatctttatttgatgattgcgatcagtattatcaatgtttatttgttgcagatcctcaagatactgtgataataaaaaacacttcaattgatgaatgtaaatttgtgaaaattgattttaataaaataaaattagttaatactcatttagtagattgtgtttttgagggatgtgatctatcaaatttagagtttaataaaatcagtattcatcgctgtcgttttgttaattgtaaaatggttggaattggttttattgattgttcaattagagacgttttatttcaagatattcagggacgttatatgaatatagctttaggaaatatgcgtaatgttgaatttaaagatgcttgtttagatgaaagcagtattatggaagtggatatgaagcagctggaatttaatcatgttagtttaattaatagtgaaatatttaagactagtttatatggattagatttaaagcgcgccaatattgagggaattagaattgatatgtatagtttaaaaggggttcatgttgatatgtatcaagcaatagcgctttcaggattactgggaataattgttgattaaagataagaaaatgatattattgacaaatgaaaaaaaataatgacaaaaaataattctgtgctataatgatgaagttataagagaggtcatgatgatgaagataagaaatattgcaattatagctcatgttgaccatgggaaaacaacacttgtggatcaattgttaaaattatctggtacatttagagataatgaacaaattacagaaagagcgatggatagtaatgctcttgaacgagaaagaggaattactattttagctaaaaatactgcgattaattataaagattatcgtattaatattatggatacaccaggtcatgcggattttggtggtgaagttgaaagaattatgaatatggttgatggagtattgctggtagttgacgcctatgaaggaacaatgccacaaactcgttttgtcttgaaaaaagctttagaagctaaagtaaaaccaattgtcgttattaataaagttgatcgtccggtagtaagaatccaagaagtaatggatgaagtattggaattatttatggaattaggagctgatgataatcagttagattttccaacagtttatacttcagcattacaaggaacatcaagtcttgatgccgatctagcaacccaagtgcctaatatggattgcttgtttgatatgatcatcagtgagattcctgaaccgttagtcgatgaagaaggaccattgcagtttcaaccagctctattagattataatgattatgtaggaagaattgggattggtcgaattcagcggggaaagataaaagtaaatgaaagtgtaacttgtgtgcgagctgatggtagtcatagccaatttagagttcaaaaattatatggctttttaggattacatcgaattgaaattgaagaggctagtgctggtgatattgtagctattgcaggacttgcggatattggtgtaggtgagacagtttgtacaacaggaaaagaggaagctttaccattgttaaaagtagatgagccaactattcaaatggtgtttggaacaaatacttcaccttttgctggacaagatgggaagtttgtaacagcgcgtcaaatcgaagagcgtttgcttaaagaaactaatcgtgatgtttctttaaaaattgaaagaattcctaatagtgaagaatggatcgtttcaggacgtggtgaattacatttatcgatcttgatcgaaaatatgcgtcgtgaaggatatgaattacaagtatctaagccaaaagtaatcattaaagaaatcgatggtgttaaatgtgaaccgtttgaagaagtaaatattgaagctcctgatgattgtattggtaatgtgatcgagtctttaggatatcgtcgcggagtattagaaaatatggtcagcaatgatggccagactagtgttacatatactattccatcacgtggaatgattggttttatgactaattttttgacgatgactaagggatatggaatcatctcacattcattcttggagtatcgtccaatggaaggtgaaacagttggagaacgatctttaggagttttgatttcaattgataatggtcagactacagcttatgctttaggcggtgtagaagatcgtggggtaatgtttgtcggtcctggcgttgaagtgtatgaagggatgatcgttggtgaacatagtcgtgataacgatttagtagttaatgttactaaaggtaaacaattgacaaatactcgttcttcttctaaagattcaacagttgttttaaaacgaccacgaacatttaatcttgaagcttgtcttgattatattaatgatgatgaattagtagaggttactcctaataatattcgtttaagaaaacgttatttaagtgaattagagcgaaaacaacaaaatcgattaaaagcgaaatagatatattatttgataaaaaaagagtctttaaattttgatgaatcttatcaaagtttagaggctttaattttttaatgggtaaaatcgtaataagggaataatggatgaataaaatggatttgattattaataattgatgtaataatattatttatttaatgttatttttggatagtcattgacattatttgtttagttatttaaaatatatattagatgagatgttactgttaaatcaggcatgacctaagtatagatataagcaaaatgtttttgcttgctctacttaggttttatttttagaaaaagtaacattaattcattatttaattcaagtacaaataaagaaatggggtgtaaaaattagaattagaatttagtacttgacgtagataagtaataatgcttgttgaatttatttaaagcgttgatttattttaaattaaagaaggagattaaaaaatgaagagattagggaagaagaaaattatttcattaatcatggttttatcaatggttattacaactatttttagtctacaaatatctaatgtcgatgcatcaactaatactgaaaaagcaaaagaactagttagtaaaatgacattagaagaaaaaattggccaaaaattaatgttgtcttttagaagcggctggacaatggaagatggtacaaaagtttcatcagttcaaaatattaatgatgaaatttataaaatcattggtgaatatgatattggtagtgttattttgtttgctgctaattttaatgcagatgcaactgtaaatgttgaattaaccgatggtttgcaaagagctgcaatggacaaagatttaggtaaaaacaatattccgttattgattgcagccgatcaagaaggtggaattgtatatcgtttaacaggggggacggctttaccaggtaatatggctttaggggctactggtgatacagtaaatgcaataaaagctggtgaaattatcggtagtgaattaagtgcagttggggtaaataccaattttgcaccagatgctgatgtaaataataatcctaataaccctgttatcggattacgttcatttagcagtaatccacaattagcagctgaatttacttctgcatatattgaaggagtacaaagtaaaaatgtagcgacaacagctaaacatttcccaggacatggtaatgtggcaacagattctcatacaggattgccttcaattaattcaactaaagaagaattatatcaaacagaactagtaccattccaggctgcaatcgaaagtggaacggatatgatcatgacagcacatattcaattcccaaatattgttactgaagaactttactcaagtattaaagatgagtttatgagtccaccagcaactttatctagagagatcttaactgatttattaagaaatgaattgaattatgatggagtaatcgtaacggattccatgacaatggctggtgtagcaagttattttgatgtaaatgaaagaaacttattagctgtaaaagctggggttgatattttggatattccttttactgatatatcttctttggctgatatgaaaacgaaattaattccattgatcaatgcgtttgttgatgcttatactaaagaagatggttacaatggaatcacattatctgttgatgagttagataaatctgtagaaagaattttaacttgcaaatataatagaaatgtaatggatttggttaatgatacaactactttagctgaaaagaaagcaattgcttcaagtgtggtgggatcagtcgaaaaccgcgaaacagaaagattgatttctgcaaatgcagtgactgtagttaaaaatgaaaatgatgtattacctcttaaattaactaatgattcaagagtagtatttgcatctacatattcaagaaataataatcgctttgttttggcttgggaaagagcaaaacaggcaggaattattcctgaaggagcagattataaaattttacaacactataattggacaggattaaatgataatgttaatagtgcaataaattctgatggtactaattttgtcggaacgaataaagatgttttagattggggtactgttcttgttcatgcttcagaaattagtagcgctggtggtatagatggttatttagttgcgtgtccacaattatttactaattattgtaaacagaatggaaaacagacagttgttatttcattaaatcatccatatgatgtacaagcattcccagatgctgatgctattttagcagtatatggtactacaagtgctggattagatattactgaatcatttggtggtggtacagtaggcgcaacagctgcgtttagtcctaatttaactgcaggtactgaggttgttttaggtacgtttggtgcttctggtaaattaccagtagacattccaaaatatgttcctggttctaaagtatattctactgatgaaaatgtgtatgaattaggttttggtattgaatatgaggctcttgctaaagaaccagataaaacagctttagtagatgttattgaccaagtaaaaggattaaaagaagctgaatttacagctgaatcttgggctgctgcggttaatgaattaaatgaattgcaagtagcgttgcaaacagcagaaaatattaatttaactcataaattagctcaaacgatcgtagatgaaactaaaaataatttacaagaaaaatatgctgcggttttagatgtattagtaattaataaaatcgatcaaacagcattacaaattgcagtagatacagctaatacattaaaagctcaaggggcattagataatgttgtacctgctgtagcagctgaatttgaaactgcacttgctaatgcagaggcagttttagctgatattagtgcaaatcaagctacgattgacagtgccttctatcgtttagctaatgcaattcatatgttagaatttgtaaaaggtgataagagtgctttagaagccttgatcaatgaagccgaaaaatatgaagaagaaaattatacgactgattcatggacagcatttaaagaagccttagatgcagctagagatgttatgaatgatgataatgctttagaaagtgatgttaatgaagcgttaaataacttaacagaggcaattggaaacttagtcttaagagctgataaaacaagattacaagaagcatatgatatggtagatggcttagataaaagtgtatatacagaaggaagtgttgctaacttagtaggaccaatggcaaatgctaaagcagtattagataatctagatgcaacacaagaagaagtagatagtgcatatgaagcattgataagagcatacttagacttaagattaattccaaataaggatctattacaagaattgatcaataaagctcaaacattaagtaaagctaattatacagcagcatcatggaaggtgatgaataatgcgttagatgaagcaatagcagttctaaataatttagaagcaactcaggaagaagtaaagatggcagaaagtgtattaaatgatgctttaaataatttagtagaaaataatgtatcaaaagttgatccaatcaacactggtgattcatcagcagtaaaaaccggagataatacatttgctcttccaatgatgttaacaggattactagctttagcgggcagtgtagtagtggtaaaaaagaaaaaagattaatatttattaaatagccgttaatagcggctatttaaattgagttgatctttgtgctactaatatttgataaaacattttgatttttgctaaaaaaaataggaaaatactaaaaaaagacccttattttaatgattaaattcaaaaatatatgataattacaataaaatttgcataaatttaagttttatgatattatagatgttgtagaaacgggggattgaaatagagatgaaatcaatatttgaagtacaatgcagaggtaaaaatgttaatacaactgaaattgaaaaaatggtaaaagaggacgttaaagcaaaaggagttaaaatttcttctattgatacgttgaatatgtactatacaccagaaacttcttcagtgtattacgttgtgactactaaagatggtgaatcaattaataacgacgaaccattaacagttgagtagtcttaatataaatatccagaatatatccaaaaacaaagagcggtatgtaataccgttttttgttttagaaaatattatgtctgttcgtttataatgctgtttccactgttttgtaaatgaaagtagaaaaattggaagtaaagaggtgattgaaaatggcaagagaattgttttgtcaagcagtattgaaatttgtacttggtttagttcttgtaaacatactaatattttttccggctggaacattttattattggcatgcctggttattcataggaattttatttatacccatgttttttgctggaattgtaatgatgttcaaaaatccagaattattgaaaaaacgtttgaatgctaaagaacaacaaacagagtaggatcttgtagtaaaactcagtggtttaatgttcgttttgggatttgtcatagcaggattaaactttcgttttaaatggatcacattaccagagtgggtttcatggctggcaactgttatatttttattttcttatttactttatgcagaggggttaagagaaaatacttacttatcacgaactgtagaaattcaacaagatcaaaaagtaattggtacaggattatatggtattgttcgtcatcctatgtatagtgcgacgattattatgtttctttcgatgccactagtacttggttctattctttcatttataatttttcttggatatcctctaatagttgctaaaagaattagaaatgaagagatattgcttgaaaaggaattagaaggatatattgagtataaaaagaaagtgagatatagaataattccattcgtgtggtaattgtttgcaattttgaaaaatcaagatatataaagtaatctatatcgtattaagaaagtaaagtgaattatgggtattggacttttttgatgatagggaacggatttgaaaatgttttgtattatcttatattttttataaaatgattttttagctgtttgaataaattaataatttttaaagattattatttttaatcttagtggttaatcgacaagaaacatgctataattactttgttttaaggagtggacaaaatgaaaaaaattatagcaggtgttttggcacttttattatttactgcctgttcaggtgatgataatagccaaacgctttttgtagcagataaaaaagggcattatggccttgttgatatagatggtgaaaaacaaactaagtttatttatgataattatgaatcaataggtaattatggatatatagtagttaaagataaacaatatggatatctttcatatgaaggtgaagaaattgttaagatgggtaaatataaaaaattagaatcgattgcaaatatgatcgttgcttatgataaaaacgataatatttcgattttaaatagtgctggtgaaagtttatacaaaactagtgataaaacaaaaatagttttatccggattacctataattcatgataataatgaatatgtagttcttcatgatactggtaaagttttgataactagtaaggatgagattttaagtagtaatattattaatgataattatattgcggtatgttttgaaaaatcgttgaaaatatatgatcaaagtgatttgaaaaaagttgttgaggttaaatgtggtggtaaatatcaattaatgtctcatagtaataaaaaaggatatctattttataatcgagaaagtcaagagactttagcttgtgataatgatggtggtgttatttttgaagctaaaatagatcttgatgatctatattttgataaatcagataatattacaggtgtaaaaaacctaacaacatatttatttgatgaaaaaggtacagcaacagcaattaacagttactataacgatttagataattatgttataaaaaatactgagatgatatatgggcctcataaatttgtttataaaggaaaagaaattgaagtaaataatattcaattagatccaatggcttcatatattactaaaaagatttttcctgtctatgtaagaggcaaaggatatatgtattatggatttgatggtaaagaagctattaagacagtttttacaagtgcggaaatttttgatcaaaataatttagcggttgtttctaaagagaacgataaatattatttgattgatcaatcaggcaaaaagatatcgaaaaaatatactaagatcatacatattggtgaaaaatattatgctggttttatttctggtagtaaatatgaagtaattgatactgatggtaaaaaggttattgatgataatttcatggatgatggttatatatttacatatgataaagtagtctatggtatttttaataagagtggaacgagttatgtttatgatatggatgaactagaagtgattttttcggttgaaggaaatctagagtttgctgatgatgggtattttgttaaagaagatagtgatggttattattcattaagtggtgaaaaaatttatacgaggtaatgagatgggttattatgtttatatgcttgtgctattagcactaatgctggtaggggtaaagtttgttttttgtgagttagaagggcatatggctaaaaaaagaggcttattgaactggtacttgaaattagctgagccatttaaatatgcacggacaagaagtattattttcatgtgtatcttttgttacatgattgtatctacacaatttattttttcaattgaatggctgattgaattaattggatttgtggcggtgggagttatttttgatggtattagtcaagtagttggatattattataataagatccgttttagaaaaaatatttacaaagctgttgctgtcaaagatgagatcaataaagcaatgacattatcagatagtaatctgatccagcaaagcatgccaatttattcgagtgcagaaatagtttcaagatatttaaatgaacaaacacatttggctgttatttctttagacggaggagaatacgtttcatcatttgaaaaactgccacctatcacttatacagttgaagcgcaatatgaaaaagcagaagagaggcttgctaagcgaaatgttaaagttacaagattaacagatgaaggtaagctgccttttaaagatgaacggttagatgttgtagtaaatgaattaactaattttgataaatatgacttatatcgtgtagttaagccaggtggttatattttagtgaatcagttaggtagtgataattatcaagaattgatcaatgtttttcttccttttaagttgcatggacattgggatttagaatctggttctaaaagtcttagtgaaattggtttagagatcgtagatggtgttgaggaacacgggtatgttcgttttaattcattgacatcttttattcattttatgaaacggatcacgcgtgttgatgttactcaagatcgatttatgaatttctatggtcaggtcttaaaacaaataaaagaaaaaagttattttgagcttactacacatcgttttatggtagtggcaagaaaaaaagaattataaaataatgaaaatgacaagtattaaatttcttgtcattttattgcttttagaaatgattgatgtataatgatactaacttattttgcatagttaagatttttgaaaaaatattagctatacaaagacgactacttttatagtaagtttctttttatacacatttaggaggaaattgtgaagaaaatattaaaaattgcagttactattcttgttttatttaatacagcatgtaaagctggtattgataataatgtgattaatactgatatagtaaaagttaaacataatggagtatcttcgcaaattgtagaagtggatgaaagtggtgaagtgattgaaaatgggtccgatgatactaatacaataaatagtcaagatacaaattcaggtaaaacaaataataaaagtaaaaattcaattgatcgtgataaaagtaattcttcgactgatcgtggaaatcaatctagcagtgaaaataaaaatactagtgaaatacaagattttaaagcagatgaacaaacgatcaatgtcacaattgcaattgattgtaaaactattcttgataatttagatgatttaaatcctgggtacagagaatatcttcctaaaaatggtataattttagatacgatttctttaaaaataaaaaaagatagcacagtattagatgtattgaaaacagtggatcaaaactataaattaaatttaaaaactcgtaagtcaccatacggtacgtatatttatggaatcggaaatattgaagaaaagatttgtggtgatacaagcggttggatgtatagtgtaaatggtagttttcctggaaagagtgcaagctcgtatcgtttaaaagaaggggataagatcaaatggcgatttacatgcaaaccgggagatttaaattagaaaggagattgatatggtcataaagaactttaaagaaagtcatcccttagtactgttcatttattttttattgattattattttatcaattattcagcgtaattattatttgattgcgttattaacgatttcagtaatcatagtagattatttttataatcagaatagcttttttaaagatatgaaatattttataattctagttttgattattacgattactaatccactttttgtaatggaaggtaaagatataatatatcaaaatagttatattattatcacacgtcaagcactgatttatggattagtatttggaatgttattaggcagcatgcttttatggtttaaaataatgaaaaagtgtattagtgatagtcacattgtttatttatttggttctattttaccaacgttaggcttagtagctgcaatgagttttaatattattaataagttaaagaatcagtatcaaaaaataaaagaagctaattatcatatgcctgctaaaaataaatttatttattatcgtgatgtagtagtaattttagttacttatgcttttgaatcttcattagatatgatgaattcaatgattgcaagaggctatggtaagactaaaagaacaagttttcatttatatacttttagaaaagatgatttattgaagttattgattattattggacttagtgtgatttgtttatggggttatattggttattatcatgagttttattattatcccgatattcaagtttatcattttaaaatgatagatatcgtattctttttagcgtatttattattagcgatttttccaatatggttaggaggaaagagagatgtataagattgaaaactttagttttatttatcctaaaggaaaagaagtaattcaagatatttcttttggtgtaaataaaggtgactttgttgtgatttctggtaaaagcggttgtggaaaaacaacattgttgaagcatcttaaaccgtcattgaagcctgaaggtgaaatgaggggaacgattatcttggatgaggaaattgaaaatgatgatacaaagataggttttgtttttcaaaatcctaatgatcaaatcgtcatggataaagtttggcatgaaattgcatttggcttagaaaatatgggtattcttctaaaacaaatgaaacgtagagtcggagaaattgttaactattttaacctgcaaaatattattaatagagatacacaatcattgtctggaggagaaaagcaactagttaatttagctagtgtgatggtgatgaatcctaaagttatattgttggatgaggctactgctcaattagatcctgttaatcgtgatgagtttatcaaaataataaaacagatcaatgatgattttaatgtaacaatcatttttgttgaacatcaattagaaggattgttagatgttgctaatcgtttgattgtaatggatgaaggaaaaattgttattgatggtgagataaaaaaagctgtagatgaaatgttaactaaagaaatatttgttgaatcattgcctgattatgtcagagtatcttctttaactaaacaactatgtttatctgttaaagatgctagaaaggcgttaattgattttgatgattttgatattaaagagatagaggatgttgatacagggattttgatggaaataagagatttgaattttggtcatgatgatattgttttaaaaaatcttgatttagatattagacaaaatgaaattctttcgatagttggtgctaatggcagtggaaaatcgtcatttcttcgctgtattgctggtttagttaaatatcaggggaaagtaacaaaaatcggttatgttgataaaattggttatttaccacaagatcctacaactttatttttgagtgataaagtaatagatgatttgctggcggttgatgaaagtgaaaaaagtgtggatatccagttgaataatttaggtattagtgatttaaaagaaaagcatccgtttgatttaagtggtggtcaaaaacaattagtagctttagctaaagtgcttttaacgcagccgcagttattgttattagatgaaccaacaaaaggaattgatgctttaagcaaagaaaatctagcggctttgattagaggtttaagcaaacatatgacgatcgttgtagctagtcatgatttagaatttgttgctaagataagtgatcgtgtcgcaatgatttttaatggacagatggaatcagttgatacaatgagagaattctttagccaaaatttgttctatacaacaacgattaataagatcattagagaaaataatcctgagatcgttttattagaggaccttggcttatgaaaataacaaagaatgcagttgttttgatcttgacggttttaatagctttgctaggagtaattttatttaaagatgaaagatataatttagttattatcttgatcgttatgttatcatgtgtaccgttttatttcaaatatgaacatgataaacctaaaacaagagaagtggtagttcttgcaatcatgattgcccttactgtgatatcacgaattatttttatgattacacctagttttaagccggtgacggtgatggtgataatttgtggtgtggtttttggtcgtgcttcagggtttatgtgtggttcattatcggcactgttatctgattttgtgtttggaattggaccatggacaccatttcagatgttagcatggggaattataggatatattgctggtatatttggtaagcggctttataaagataaatattttttatatggttatagcattgtttgtggaattggttattcattgattatggatttgtggtcagttctagcgatagagaatagttttaatttaacgaggtatttggcaattatcatgacatcgctaccagtgatgttagtatatattgtttcaaatataatttttatgtttttattaagtaagataatgtttcaaatcttacaaagagtaaaaataaaatatggaataacggagggaaaagtttaatgaagaaaattctaagtttaattgtatcattagttgttatggtaactattgttgtaccggttaatggacaatcatatgctttaactaaagcacaaaattattggttgaataataaggagctaagtggaatagatgcaattttaactgttgaagcacttggtttagatgttgaagatagtaaaaatggttttgttgttgattatgattttgcagctcctgtaaatagttatggtgaagaaatttcttatgaagatatggattgtggatatttatcaaaaaatatcatggctttagcagcattgaaaaatgatcctgcaaaccttaaattagcaaatggttcaacagtaaatttaattgagattttaaaatcaaaaatagatgacgaaggtaatgttttctatggtagtgggaatcctgagtctagtactgcttatacaatgtatgctttgtcaatcgtagatcctgattatgatcttagtaaattgggtgcaaaattagcaagtatgcagttaagtgatggctgctggggttataatggtgcctggggtggtcctgatattacaggatgggctgttggggcattatcattatgtggcgatacatatcaaagctcaattgacaaggctttaacatattttatttctattcaacaagcagatggtgcttttgtaccagcaggtgaatggagtgttgctaatagtaatacacaaggttgtgtagtttggggattattggaatatgatgaaagcatcataaaatctggtacgctaaaaaatgcttatgatatgttaatgacatttatgttagatgatggatcttttgcatataaagccgatgaggattatggtaacagctattctactgtacaagctggtttagcgttaggggtttatgaaaatggttcattgtttactaatattcgtaatcaatatttaggtgatgaagatttacaacctgaagaaaccgaaaaagaaaatgagccagtaaaaacacctgtaaatgatagtgatgttccgacatctgttgaaacaggagatggtgctttgattatgacaagtatggttgttatgatcgttagcggtggagtttatcttacagttaaaaaatatatttaatttactctaaatagcggtttttaaatccgctatttttaaaatttatataataaataatgtcattaaaattgaatttttgttgatatacagcgataatttgtaagcgctaaattttgttcaaaaagtactttaaaacagacggtttaggtggtataattagtgtatagaaattttaaggaggagtcataaaaatggcagaaaaattatcttttgtagtatctgatccagttggattacatgctagaccagctactatcttagttaaccaagctagtaagtttacaagtgatattaaattagtttataatggtaaagaagtaaacttaaaatctattatgggagttatgtctttaggtgttcctactaaagcaactgtagaaatcattgctgaaggtgatgacgaaaaagatgtaatcgtttctattgctaaagttattaaagaacaaaaagtagcagaataagaagtctttggacttctttttatttgtaggaggataatatgtcaaagtcagttaaaacaaatgctttaagattgttagataaagctaaaatcaaatatgaaataaaagaatatcaatatgatgaagagcatttaagtggtgaacatattgtatctcaagtagacatgaaagcaaaagatatttttaaaactttggttttaaaaggaaataatgactatttggtttgttgcattcccgtacttgaagaaatagatttaaaaaaattagccaagctttctaaacataaaagtgttgcaatgattccaatgaaggaacttttaggaattactggttatattagaggtggctgttcaccggttggaatgaagaagaagtttgacacgtattttgacagttcggttgatgaatgtaacaaaatagctttaagcgctggaaaacgcggctatcaaatggttgttgacgctaaagaattaataaaatatttagatgctgtaattggtgatgtaattaaggagtaattatgattcaatgttattatggtgatggaaaaggaaagacgacagcagcgataggtcaggcgctaagaatggcaggtgctggtaagaaagtaattgtgattcagtttttaaaagatggtaatagtagtgaaaatataatgttgaaaaaatgtggaataaaggtatttgccaaaaagatgccggaaatgtttattgatatgagtgattcaaaaatgattaaagaagttagtgagcaggtcaataatttattttcaatgattgatgaaaattgtgatggaattattttagatgaattattagatgctttgactttggggcttattaatgaggggatggtatatgaccgtttggttgctttaaaagatgaccatgaaataattttaacgggaagaagacctagtcataagcttaaaatgattcttgattattctagtgaaataaaaaaacataagcatccctatgataaaggaataatggcaagaaaaggaattgagtattagaagcaaatttgcatttaagaaagataaaatatcgtaatttcatgaacaaaacaagtagtcaaaattaaggagatttgttataattaatacaagaggtgaaaaacatggattataataatgaatatcaaagatgggcagattgtgaaaacttggacccatcattaaaagcagaattagctagtatgagtggaaaggaaaaagaagatgctttctatatgaatctagaatttggtacagcaggtatgcggggaatcttaggtgctggtactaatcggatgaatatttatactattagaaaagctaatgtcggttttgcaaaatatgtattaggtttacctgaggggaaagaaagaggagttgcaattggatatgataatcgtcatatgtcatataaatttgcaattgaaagcgctaaagtattagccacttatggaatcaaatcatatatttttgaaagcttgagaccaactccagagttgtcttttgcagttcgctatttaaaatgtgctggtggtataatgattactgcaagccacaatcctaaagaatacaatggatataaagtttatgatgatactggatgtcaattaattcctgaatggggagatcaagttgttgcttatgtaaatgaagttaaagatgaacttgcaattgaggtagttagtgatgaagaagcttatccatttattacatggatcggtgaagaggttgatgaagcatattataaagaagtaatggcaattgaaattaatccaggaatggataagaatgatttcaaaattgtattttcaccacaacatggtacttcaaatttaccagttagaacttgtttgacacgtttaggatatgatgttgtgccagtgttagcacaatgtgcacctgatcctgatttttcaaacactgcttcaccaaatccagaagtagcttgttcatatgatcttgcaataaaaaaagcaaaagaagtagatgctgatgtcgtagttatttgtgacccagatggtgaccgcttaggggttgtcgctaaacatgatggtgaatatgtattgatgtctggtaaccaaagtgctgctgtatatcttgaatatattttaagtgaacttaaaaaacaaaataaattacctgataatgcggtaatgtataatacaattgttactagtgatttaggagaattagtttctaaatcatatggtgttgaagtagaaaaaactttaacaggatttaaatttataggtgataagattcgtaaatatgaaaaaacaaaagaaaaagaatttgtttttggatatgaagaatcttatggatgtgtagttaaagattttgttcgtgataaagatgctgttcaagcagtagtaatggctgcggaagcaggtaattattataaaaaacaaggtaaagatttaattgatgttttaaatgaattatatgctaaacatggtacatttaaagaaagtcaaattgctttatctaaagcaggagctgcaggtgctgcaagaattaaagaaatcatggataatttacgtaaagatgctcctacagaaattggtggtgtcaaagttgttaaagctgaagattatggaaatagtacatgtagtgatggaacaacaattgatttacctaaatctaatgtattaaaatattatttagaagatggttcttggatcgctgctcgtcctagtggaacggagcctaaatgtaaattctatttctcaattaagggaacagacgctgatgatgcagcaaataaaacagaagttttccaaaaagatatgatgaaaattatcggtgaataataatcctaacaaaaaagagttgatttaattacaatgtcggcaatttaagatgttgatgatttattatgattatactttttaaaatgaaaatgagagtgtaaaatattttgtgtaaaaatcctccttgggtagaattgaattaactaccaataggaggattttaatatgagcaaaaatatattatagatgaatatggagtaacttttccaaatgatattattaattcattaaaggatttattaggtgaaacctttttggaaatgatgaatgctgaatttgataagcatatgggttacagtaaatataaccagacagttgaagtaatggcgtttcgaaaaaaacagttaagactacccagagtgaaattgatatcaatgtctttcatgacagaaatgctagttttgatccgctgattattgaaaaatataacagagatatttctgatgttgacaataagattattaacttatatgccagaggaatatccaccagagatataagtgaatctgttaaagatctttatgacgtagaagtcagtactgtaatggatgatatattctatttttggattatatttgaatatagtaggttgttgaaaacagttattactatgataatgttataaaaaataacgctttaatactcaatgcagttgctcataattctatcattggatgatgcactttacacaaaattatttacagggtcaaaataggaaatgatgttacggaagttgattaaaataaacaaagaaataagagattatacagaatgcattgttttaggactatcacttagataatgttttttcagttctagcataatattacagttgttttgtattttctgtttattgatagattaaaaatagaaataacaaattttttatgtatgtcatccacggtactttttgtaacaatagcttttataaattatcagggaatgaacgctgaacagattgcctttaatatttgatggtcttttttgatgaatcagaagtatattaagttacagaatttatattatgagtttctacaggatacaataagttattacagaaagaaagttaatatgaaaaaaagatatggtgacaataaaagaaatttttgaagcaatgtatctgaaagagtatgttgttagaagatttattagagaaaataagattgtttattttataagtaggaataatgtgtatattaattatcactatctaaaaaaattgtgtatttcaatgaattaaaagtataaataaaatattttttatagaacttttgatatatacgatgtttttaacctttttgaaatgatataatttattttgcttttttcatttttttaaagataaacattacgaatatgtagctttatatgggattaaaatctatgatttcatcaagaaaatattttatcaagaattttataattatatttacttagtaaaaaaattttttcaacgattttaatatgaagtattgttttgttaaataatgttataatttctttatgtggaaaatgtttatgtagaattatatataacaccaagtaaatatcgttcattaatattttttaattagttaagggggaagaatcatgttttgtgattatcatgttcatacaaattatagtgatgatagtgaatatttaatggaagatgttgtaaaagatgctatcgagctaaagatgaatgaaatttgctttactgatcatgttgattatgggataaaggttgatcaggaaaacttaactgaggaagaaaagatagaattatctaaaggggatgaatttgcgccgttgaatgtcaattattttcaatattttaaagaaataaacagacttcaaagaaaatattcaaaaataaatttaaaaaaagggatggaatttggtattcaaatacatacaattcctatgtatcaaaaattatttaaacaatatgattttgattttattattttgtcttgtcatcagatagaagatcaggaattttggacacaagattttcaaaatggaaaaactcaaaaggaatataatgaaagatattatcaggaaattttaaatgttattaaaaaatataaagattatagtgttttaggacatcttgatttgatcgtaagatatgataaagcaggtgtttatccttttgaaaatattaaggatattgttactaagatattaaaaattgttattaaagatggcaaaggtatagaagttaatacttcatcacatcgttatgatttagtagatttgacaccgtcaagagatattttaaaattatataaagaattaggtggaaatattattacgataggtagtgatagccataaaagagaacatctaggtgcttacataaaggaaacaaaaacagaactaaaaaaattaggttttgaatattattgtacttttgaaaaaatgaaaccagtttttcacacattataaaagtcaacttttgttgacttttaatctatgtaatgttctattttatgattaagatttttctcgtaatctctattaaaataacatgcatatatacaatccaataaatattgtaaggaaatacgtgaagaaaaagatgcaattttttcttcagaatcttcataagatgaaaaataaagatgataatcaacatattttgcaatagggatttgaatcgtagaagaaataagaatcatcggaatgcctttttcttttaatgttttaacaatatctaaaagataaggggttcttccagcataactaataatcattacaatatcatttttttgacatgattgagtacgccaatgctgataaaaatgttcttttacaacatcgactttaactccaatttctaacatattctgttgaaaactttctgccataaaataattaccaatagaaggaaatataataatattttgagcattatataaagcttgaattatttttaaaaagatatctagatctattaagttgaatgttgatttcaatgtttggtcataaagtgaaagcattttagacatgatttggtgatgtgtattatgcttatggaaaggataattataatcaacagcatgattttctggtttgcgattttcaagttgtaatgagatctgtacttttaattgattaagaccagaaagtcctagtttttcaataactctatagatggtagaggcagaaacataactgctttttgcaagatgttgaagatcaagttttataacattatgaggatggttaacaatatattcagcaaatattttttccccttcagtaaagttattgacttgttttatttttgtgaaaatattcatgttacatcatcctttcttttatgtttattatattaaaacacactatgattttatttcatagtgtatttcaatttattctttattttttatctttttacaagattctctttttattaatgtacatggcagtatcatttttactggcagctcatcttgttcatttagtaaggtatataataacatagcaccatattgtcccatataaaatgcaggggcgtgaatggttgtaaggggtggatttgtataatttgcatcatcgatatcatcaaatccaataatagaaatatcatcaggtacattaatattattttctttaagtgctctcatagcaccgatagcaatgggatcactagcggctatgatggctgtaggaagctttttgctcttgatcatttttgacatcatattatatcctgattctctagaataacgctctatatatacataaccctgatattgtatatgattttctttacaatatttttcaaaagctagatatcgaaaatctttatattttgttgaaaaatctaagtattcatttcctcctaaatatcctatttttttatgatttaatgaagttagataattcatcatatcatagatagcattttcaaaatctagtgaaatagtattatgattgatttttgatgtttgcatatcaataaaaataatttttcttgaaatacttttgagttctaatatttcattatcagaaaattttccaatacaaataattccatttacattttttaacttttcaatataattaccatcacttttgaatatgcggataatatctatattatctttagaacaaaaattttctacaccatttctaattttcaaataaaagggatcatccatttcctgttgtaaagaataccattgtaatataccaatagtaaaatttaattgtttgttttttgctttttttacataattaagcttattaacggcatttcgtatattttgctgtgtttcttcaggaaggattaaagatgtatcgttatttaaaaatcttgaaactgttgctgatgaaacaccggcaaggttagcgacatcttttaaagtagccatatacttcacccctttcgatttactatgttatattatatcgaattattttctatttgtatagaaattccatgctgtaaaaataatttgatttatatcagtatattttgggttccaattaagaatttcaaaagattttttattatttgcaattaattttgctggatctcctgctcttcttttacaaatattaactttaatatcctgttgtgttacttctttaacggcattaataatatctaaaacagaatatccttcaccgtttcctaggttaataatttgagaagaatttccttcttttaaatagtttaatgctttaatatgggcatcggctaaatcacatacatgtatataatcacgaatgcatgtaccgtcttttgtgtcataatcgttgccaaacacattaattgcttctcttttacctaaagctacctgtaatattaaagggattaaatgagtctctggattatgtaattccccaattgatccatttggatgggcaccacatgcattgaaatatcttaaagctacaaaagacattccataagcagctacacaccatttcatcatatgttccatagttaattttgtttcaccatatggatttgtaggatttgtgtcatcagtttcttcaataggaattctcttaggttcaccataagttgctgcagtagaagaaaatacaatatgtttaacgttatgttttttcataacttttaataatacgatcataccataaacattattatcatagtactctaaaggctctttcatgcttactccaactaatgaatttgcggcaaaatgaatgactccttcaatattttccttttcaaatacgttgcttaagaatatctcatctcttaaatccccttgatagaattttgcttttggatgaattaattctttaaatccagtttgcagattatccactatgacaacatcattccccctttcgattaattcataaactgtgtgactgccgatatatccagcaccacctaaaactaaaatactcataattttattcctccttttcaacatcataataaatctttagtaaaataatgtcaatatatttagtaaaatatataaataatattcagtaaaattattgacataatttactaaaatatctataatatcacgcgaggaggaactaagatgaatgaaaaaattaatcaacttattaattttgctttaaaaaatgaaatgataaaaaaggaggatgagtattattcaataaataagctattagatttactaaaaatagatcgatttaaaagatgtgaagttgatgatatctctttatatgatattttggatagtatgttgaaatatgcatgtgaaaaagaattgatagaggatgatatgacgaatcgtgatttatttgatacatgtattatggactgcattatgcctagaccaagtgaagttgtaacaaaatttaatgaattatataaaattagtccacaaaaggcgacagattattattatgatttatctattcattcaaattatattcgaaaatcaagaactgataaaaatattaaatttaacgcttattataaatatggtgatattcaaatctcgataaatctatctaaaccagaaaaggatcctaaagaaatagcaaaagcaaaacttgtaaaaagcagcggatatccaaaatgtttattatgtaaagaaaatgtaggttatgctggacatatgaatcatccagctagacaaactcatcgtattattccgttaagtttgaatgataatcagtactttttacagtattcaccatatgtatactataatgaacactgcattgtatttaataatgaacatattccaatgaagatagatgaaaatacttttaaaaatctatttagttttattaaacaattcccacattatatgttaggaagcaatgctgatttgccgattgttggaggatcgattttaactcatgatcattatcaaggcggtaagcatcattttccaatggaatatgctcaaacaattaaagaaattaaaattaaagattatgatgtaaaggtagaaatgattaaatggccattatctactttaagattaacaggaactaatgatgaagaagtggtcagattatcaacttatattttaaataaatggattcaatatagtgatgaaggtttagatattgttgcatttacaaatggagaaaggcataacacaatcacacctattgcaagaatgaaagataaccaatatcaaattgatttggttttaagaaacaaccgtacaagtgaacaatatcctgatggtatcttccaccctcatcaagaacatcatcatattaaaaaagaaaatattggattaatagaagttatgggattagcaattttaccagctagattaaagaatgaacttgcggatttaaaggagtgcttattaggaaagaagaatattgaagattttgatgcattaaaaaaacatattgaatggtatgagtatttaaaaactatttctattgatgaaaagaacatagataagatattagaacaagaaactgtaaagaaatttgtgagtgtgttagaaaatgcgggggtttataaaatgaatgaagaaggaattaatgggtttacaagatttgtagagtatttaaatgagtaaattaaaactatataaatgaagaagggtaaaatttttatattttaaggcatggatatggaagcaaaaaaattattagaaaaatttaaaaataatgaatttgatgaattattaattgatgtatatgacgatattcaattattagaatatcaaaatcatagatatcaaaatgcaattcaacaatatattgaattatttggaaataatgatgtagaaatttatagtggtgcgggtcgtagtgaaataggtggaaatcatactgatcatcaacatggtcgtgtattagcggcatcaattaatctagatgctattggtattgttacaagacaggatggaattattaaagttgtttctgataattatgatattgaccctattaatattgatgatttagaaaagaaaaataatgaagaaggtacttctgaagggttgattcgtggtgttgtttctgagttaaaaaatttaggatataagattggtggatttaacgcatttattacaagtgatgtattaatgggggcaggtttgtcgtcttcagcttcgtttgaaatattgataggaacaattattaatggattatataatgatatgagtattgatatggtaacgcttgctaaagttggacaatatgcagaaaatgtttattttaaaaaaccatgtggattgatggatcaatgtgcgtgtgcagtcgggggattaattagtattgattttaatgatgctgcaaaaccgattgttaatgctttagatgttgatttttctaagtataatcacagtttatgtattgttgatacaaaaggatcacatgccgatttaactagtgaatatgctgcagtaccacaagaaatgaaagatgtagcaaaagtttttggtaaagaggttttaagagatgttgatgaaaaagaattctatgaaagaataactgaagtaagagaaaaatgtacagatagatctgttttgcgggcaattcatttttttagtgaaaatagaagagttgagcaattagttgatgctttaaaaaatgatgattttgataaattcaaagtattgattcaagattcaggtaattctagttataaattcttacaaaatgtgtatgcttcatgtgacttacaaaatcaggcaatatctattgcattagcaatgtctgaaattattttaggagattatggtatttgtagagttcatggtggtggatttgcaggaacaattcaagcatttgtagcagatgaatatgttaatacatataaagaagaaattgagaaaatctttggtaaaaattcttgccatgttttaaaagtaagaaagtatgggggaaagaaaatattgtaatagataaagtgtttattaatcagtatacttatcttctttaaaaattatttgataattatatctaatacggtcaaatcaatagatttaaagaaaatataaatatggtgaggggaatctatgaaaaatatattaaaattagatttaaaatatgcagctagtcaaattttctattatggagctgtttgtgcgatgacgggatatgcatcagtatatctattagataaaaagtttaataattcgacgataggaattgttttagctttatgcaatgttcttgctgttgttttacagccaatattagcatcatttattgacagaaataaaaatattgagctaagaaatgttatttcaatcattatgataggtattattattttatcaatgattctatatgtttttcccataaactgggtaatcatcttaattttaacagtttttattttttcaatgataacaactattatgcctctgatgaattctttagcttttatctttgaaaaatatggaattaaaattaattacggttttgctagaggattaggatctgttgcttatgcattaacatctatgatattaggttatatcgtagaaagctttacaccgggcattttaccattattctatatcttttttagtgtttctatgtacattgttgttaaaatgtttgttcttcctaaacatcaacactttgacacaatagaagtagatgctgttcaaaaagaagatagtggtagccaattatcattaataagcttttgtgtaaaatataaaaaatttataactttcttatttggttttatcttagtctattttgcacatacgatcattaattatttctttattcaaatcattataaatatcggtggcacaagtagtgatatgggtaatgctgtttttttagcatcattgttagaactgccaacaatgacatatttcacaaaactaagtaataagataaactgtggacgattgattaaattttcgattattatgtttttattaaaacatgttattgcttatttagccacaaatatgatgatgatttatatatcccaagtattacagctttttgcatatgctttatttattccggcatctgtttattatgtcaatcaaaagattgcgattaatgatcgagtaaaaggacaatcaatggttacaatggccatgactatagcaggtgtttttgctagtcttataggaggaatgttaattgatagtattggagttcatcttgttttgatggttggagcaattgtttcaactataggagcagttattgtttgtttaacggtagaaaatgtttaaaagatcttgatgtttttcgaaaagattattatcaataaaggtgataagagttttaggagtccattcgatatagaatgactcctttttatataaaactattttttctgatttgtcatttttttatttattttgggaatattttttcaatatcaagactaatgataaacaaagaataaaaaaatgatactatttttgtgttaggagggataaaagaagagtttatcaaaataaaaaaggtctaaaacatagaccgttatatcatgtttttctatattctgaaggagaaatagagtattcttttttaaatatttttgaaaaagctaattgatcatcaaaccctaatgaatcagcaataactgaaattggtaaatcagttgtttttaaaagggcttgggctttttttagttttaaattttttaaatagttttttggggaaatatcaaatttatcatgaaacatttttgttagataatttggatgaattccaaattctttagcaacatctttgattttaattttttctggataatttatatctaaatagtgtttgacttcatcaacgatagactgattgtttattttcttttcatctaaaccaatatcttcaaataacatagatataatatctagtaagatactattacatttaaaatagcgactaactttatttctttctagtttgagaatctcaaaaatcgggtttttatatttattgatatctaaattatgaataataaatacatcttcagtcgagttcatcaattcataagtatacatttgagaattgataccagaaaagtttatccaaacatagcaccatggatcaattgcatctgcttcataatagcatacttttcctgaaggaattataaatgcatcgcccttagataaatgaaagatatgtccattgatatgaaattctcctttcccgtaaagtacaaaatggatcaattgatatgagcggaatcgtggaccacagctatgacctggtcggcattcttcaaatccagcactataaaaagataagtcagatatagaattatgtaaaaaatgattttgtgtctccttatattctttcatgattttattataagtgaaaatcttaactttttctatatttatttatgaaaataccatattaaagagctatctagtattatttaatataaatataaaattagtttttagagctgatttggaaattgttgtaaaggaggaaaataatgagtataacatttcacaaaaataatcattttgttcatatgaaaaatgaacagataagttatattatcgaaatattggatagaaagtatttagttcatcgttattttggaaaatcgttacgtgaattccacgataatgagcagttctattattttaaaagagcatatacaacaaatggtgatttaagtatggaaaatgcatcttttgatgatattcctagtgaattacctactaggggcagaggagattttagaacacctattttagcaatagtattagaaaatggcattgagtatcttgatcttcattttaaacaatggagaattgtcgatgaaaaaccgttgttagagggattacctagtacatttgctaataatgatgaagtcgaaacattagaaattgtatgtgaagatgatattgctaaagttagggtttatttatattattcaatttttaaaagcaaaggattaattacaagacatcagaaaattgaaaactatggttgtcaaaccctaactattcaggatgcaaaaagtatatctttagatttaccacatcaaaaatatgattggatttctctttatggaacacatgctaaagaagctaatatagagagatttgcattgcatcatggaattcaaaagattgaaagtgttagtggaagcagcagtcctcagcatcaacctttttttgctttagtttcacctgaaactaatcaatttcatggcgaagtatttggatttcatttagtttatagtgggaattttattgcccaggctcaggtggatcaatttggcagagtaagagcacaaataggaattaatccagatacatttacatggaaattaaaagggggagaaatttttacaacaccagaagcagtcttaaattattctcaaaatggtttaaatgagatgagtcaaaattttcattggttatatcagtatcatttaatgcctaaacgatttgaaaatatggaaagacctattttgttgaactcatgggaagcaatgtattatgatgtttcacttgcaaaaattgatcgacaaacagatttagctaaacagattggtgtagagctgtttgttcttgatgatggctggtttagaagtggtaatacgagtgaaagtgcaattggtgattggaagtgcaatgaagcaaaattacctggtgggattaaaagagtttcaaaattagttcatgataaaggtttgaaatttggtttatggtttgaaccagaagcagttagtaaaaatagtcaattatatgaaaaacatcctgattggattttaaatgttccacaatactcacctgtagaaggaagacatgaatatttattagatttatcaagagaagacgtaagaaattatattataaatatttttgatgaatatttaaaagacggatatattgattatgttaagtgggatatgaatagacctttaacagacgttaattctttattattaaataagtgtcaaaagggtgaaatttatcatagatatgttttaggattatatgaaatattagaaaaaatcacaacaaggtattcaaatgtattatttgaagggtgttctagcggtgggggaaggtttgatccaggaatactttattatgtaggtcaaaattggtgtagtgataatacagatggttttgatagagtacacatacaatctggatttggcttactatatccgccaatatcaatgggggcacatatcagtataacgccaaatcatcaaactggtagatggacatcattagatacacgttataaagttgcaaaattatttaatttaggatttgaattagatttagagcaatgttgtcaaagtgaattagacgatatttgtaatcaaattattgattataagaagattcgtcatcttattttaaatggcttgttataccagcatgatacgtttcatgaaaactatgtcatgtggtctttatgtgataaagagggtaaggaatgtattgttatgatatttcaaaaatattatacaccgcttagtgctcatggattatttaaaataccttatttagatgctcatagtaattattgtgaattatcaactcttcaaatatatggtggagatgaattgcaaaatattggtatatctgtacctttagcaaaagaggattttcatatttttgaatttcattttgttaaaatttaaatatgtattgaaaatattagttttttccatattttaatgaaaaaacactatacaaaacaattgttgttaaagttaaaatattgtcgagttaacaaagaatatgcatatttataacttagaaaggagtagacatgaaaaaattgattttagcatcacatggagaacttgcaaaagggatgaaagatacaatgaaactattagctggtatcgatgatggcatatatgccttttgctttcatgatggtgatgatgtgaaagatatatttaatcaggttaatgcaatagtaaatgaagaagatgaatttgttattgttaccgatttgccaggaggaagtgttaatactgtattgacaccattagttaaacataaaaatgtacatttgatatcaggtatgaatacagttcttgtattaacgctagtattaaattttgatgtcaacacaagtagtatcttgggaaatattgaagagggtaaaaagtcattggtttatatcaatgaaatgttaaaagaaaataaagaggaaagtggggatttttttgattaaattaatgagaattgacgaacgtttaatacatggtcaagttgcagttgtttggagtaaacatttaggaattaacagaattgttgttgctgatgatgaagttattaaaaatgaaatgcaaatgatggctttaaagatggctgttcctaatggggtgaaagcaagtattatttcaagtgataaggccattgcattattaaatgatccacgtgcagaaagcttgaaaattttattgattgtaggaaatcctgaaacagcattaaagatgatgaataatgtaacaggtatacctgcggttaatgtagggaattatggaagaatgtcacagcttaaagaaaataatgaggaaaaagaacaattagagaagaatttatttgtgacgtcttcagataaaaaagtatttaatgatttgattgaatttggtatagatgtctattatcaaccagtaccaactgataaagcaaaagtgataaaatcaatgatttaattgaggagggaaattatggttattgaagcattattaattggattactcatgtttttagggatgttaacagatacaggattaggggatccgatgattaaaagaccactagttatgggaacattaacagggttagtattaggggatttacaaacaggtattattacaggggcatcattagaagtaatctttttaggaattacttctattggtggagcattaccttcagattcgtttacaggttctatttttggaacagcatttgctatcttgtctggagagggaatagaagttgctatggcattagctgtaccaattagtttattagctacaacaattacaacagttgttaatattggatttgcggctatgatgccacaagttgataaatataatgaagaaggtaatcaaaaaggtgtgactgctattcatttggcttgtatgattttaaaaccattagcatttggtgttgttggatttttaggaataatgttaggagctgaagctgtttcaacatttattgatgctattcctgatgttattatgaatggtttaacagtagcaggacaagcattaccagcattagggatggcaatgttattaaatatgttatgggataaacaaattgctgtattccttgttttaggatttgtgctatatgcatacttagaattacctcttattgctatttgtttggtaggtttggtaattgcaatatatacaagttataaagatatgcaattaaataatttaatgaaaaatcatagcacatctatggctgtagataatactgatgaggaggatttctttaatgattaaagtaaaagagggtttatctaaagaagataaaaaaatgttaaataaagtattcttaaggtcatttacaatttttgcaagctggaatcaagtaagagcaagtggtttatcttatgaatatgctatgcttccagttatcaatcgttactataaaacaaaagaagaacgtactgaagccatgaaacgcagcgcaggatattttaatatcaattcagctttatcaacttttccattaggattagcagccagtatggaaaaagaaaatagtgaaacagaagattttgatacatattcaataaatgctgttaaagctagtttgatgggtcctttatctggaatagaagattcatttttttggggaactttccgtgttattgctgctggtataggtatttctttaggacaacaaggttctatattaggtccaattattttcttacttctttataatattccatttattttaactcgttattatggaacatatttaggatttactttaggaagtaaatatattaaagaagcatatgaaaatggaatcatggctattattacaaagggtgtaggtatattaggattgatgatggttggtggaatgatctgtcaaacagttggtttaaatactatattaaatttcaatctaggtggaattgagtataagttacaagagattctagatcaaattttaaaaggtatgttaccattagcagcaacatttatttgttttggattaattagaaagaaagtaaatccgaatttaattttaataggtattattgtagtaagttttgttttaagtttattgggcatttgtggataataaatgcaaaaaatgtttgggtattttttgctattaattatataagatttataatattgtctaatgttataaattatctgttaaaaaatctgagatattttctcagattttttaattattttaattaaatataaggcaaatatttttatttaataattaagataagaaaaaataattttaaaatctcattatgttattagagaaattttaaaattaatccaaaaatcttgttatagtgatattgattaaaatattaaaaaagaatttgaaatttttttcaaaatactttaaaatacttttagtcgtgtagcgaaatatatgcaaagcgtaattataaggtcacttatattacgcttttcttttttgttatattaaagcaaacgataaattatttttaggaggaagaaaaatgccaaaaactaaaaaacaaggtattatatttggaatcattatgtcaatgacaatggcatatggaatggaagtttacaacgttgcaattaaagaaggtcttcatttaactaatggcgggttcagcaatatgacaaatagtgtttttcttgatgcattttttgaagctgcttatatgtggatttttgtctttatattctctaatttatggggaaataaaataggtcatgcattagctgaaaagattattagacctgaacaggataatcctttttttattactcttattatttcagcctgtacagttcttattatgtgtccaacaatgagtatgatagcatctatattattcaatgtaattcttgctggtagtcctataactcagcttccagctatatgggtaggaacgcttatcaaaaatttcccgatggcacttttatggaatttatttgctgctggaccaattacaagactgatatttggaaaattagcacataaaattaattaagtgaagaaaattatattagaaatataaaaatatttatttaaagaaatcatcaaaaaggaataagattaattaatcttattctttttttgctttagatcaaatattgtaaaagtttaattgtattaagaatttttgtttatacagcgtattgaaaataacaatgtgtttaatctagagtggtgtgaaagcgctatctttttttagtggaattatttttataatatgttataatgtttgtgtctaaaattaataaagggggagtgacacatgctcgatgattttttaattcacgtatttcataaaggaaatactcttgaggcgtacaaactttttggtgcccattttgaaactaataaccataaaaaaggtgtccgcttcaccgtatatgcacctaatgcacgcagtgtacaagttgtaggtgagtttaatgactgggatggaaaagatcattatatggaaaaatatagtgatggtggtatttggactttatttattcctggcattaaagaatatacattatataagtatcgaatcgaaacacagaattttgcgactgtagatcgtgcggatccatatgctttttatagtgaacttagacctggaacagcgtcaagtgtttacaatatcgaaaattttcgatggtctgataaaagatggatgaacaagcgcactaagaattttgataaaccaatgaatatttatgaagcaaatattggttcatggaagatgaaaaaggattttacagatgaagaagatggtgaattctatacttatgaagaaatgattgatttattaataccatacttagtagaaaatcattatactcatttagagttaatgccattaactgaatttccttttgatggatcatggggatatcaggcaacaggatattttagtattactagccgttatggaaagccaaaaggacttatggctttcataaatgcttgccataaagcgggtattggtgttattatggactttgttccagcccactttgtaaaagatggtcatggattatataagtttgatggtggttttgtctatgattatcctgatatcaatcgtcgatatacagaatgggatagcgtttattttgatgttggacgtgaagaagttcgtagttttttaatgagtagcgtaggttttttagcagaatattttcatatcgatggaattagatttgatgcaattagtaatttgatttattggaaaggaaataaagaagctggtataaatgatggcgctcatgagttcatgaagcgtatgaataatcatatgaaaggttattatccaggcgtaatgttaattgcagaagattctagtgattttcctggcgttacaaaatcacctgatataggtggtctaggttttgattataaatgggatttaggctggatgaatgacactttgaaatatatgaagctaaatccagtttatcgtaaatatgatcataatttattaactttttcaatggcttatttttatggcgaaaactttattttaccattctctcatgatgaagtagttcatagtaagggaactattattgataaaatatgggggaataatgaacaaaaatttgcgcaattgaaaacattatatacttacatgatgattcatcctggtaaaaaattgaatttcatgggaaatgaattaggtgagtataaagaatgggatgaaaaggtttctttaggatggaatatcttaacatatccaatccatgattcattccatgaatttatgataaaattaaatgaagtatacaaagaccatctttgtatgtatcaacaagattatggtatggatggctttgaatggcttgtagttgatgattctaatcaaagtgtttttgcgattgaacgtaaagatacaaatggtaattcattgattgcagtaatgaactttacagaaaataaacatactggatatatgattccagttaataagccaggaagctataaagaaattttaaatagtgatagagatatttatacgggcggtaattttataaataaacgcgctattagagctaaaaagggacaggttttaaacaaagactattatataccagtaaatattgcgccttttggcagtatgatctttgaatacaaaccaattaatagtaaaactgataaataaggggaagtaaaatgtttaagacaaaagaagagtttaagtatgagttttcaaaaagaattattgaaacatatggaagaacagtagaagaatcacatcttactgaaaaattcttagtattagaattaatggtaagagactatgcctcagtaaattgggcaactagtaaagctttaattcgtaataattatcaaaagcaaatgcattatttttctatggaatttttaatgggtcgtctattagtcaataatatgatgaatcttggtatttacgatattgcaaaagatggacttgcggaatatggaatcaatatccatgatttagaggaattagaatctgatgctggactaggaaatggtggtttaggaagattagctgcctgctttatggattctcttgcttcacttgcttatcctggtcatggacatacaattcgttatgaatttggattatttaaacaaaaaatagaaaacggatatcaaattgaattgccagaccaatggatgcaaacaggatttaattgggaagtaagaaaacctaagcatcgtgttccggtaaaattctttggaaaaattgtttataacgaaactactggaaaatatgaacacgtggatgcggaagaagtttatgcggttccttatgatgtaccaattattggtaatggaactacaacaactaatactttgagattatgggaagcagaagctagtgataatattcctgcaaatcaaaactttagacaatacatccaaaatgtacgtgatatttgtcaaatgctttatccagatgattcaacaccagctgggaagatgttgcgtttaaaacaagaatattttttcacatgtgcaggattaaattcaattgtaaaagctcatttaagagtttatccaaatatgaataatttccatgaaaaaaatgttattcaattgaatgatactcatccagtacttgcaattccagaattaatgagaattttaattgatgaaaaaggttatgaatgggatgaagcttgggatattacaactcaaacctttgcttatacaaatcatactattttagctgaagctttggaaacatggccaattgatttaatgcagtcattattaccacgtatttaccagatcattgaagaaattcatcgtcgttttattggttatgtaaagatggtaagtaatcgtgatgaagaattgttgaatcgtgttatgattctaagagatggtacagtatatatggctcgtcttgctattgtgggaagttttagtgtcaatggggtagctaagttacactctgatattttagttcagcgtgaattaaaagattttgcagttttatatccaaataaatttaataataaaactaatggtgtaacacatcgtcgctggctagcatattgtaatccagaacttgcttcattaattaatgaatatattggtgatgactggatcaaagatcctgataagttagaaaatttaatggatcatgttgacgatacagttttacaagatcgtttcttagaagtaaaacgtgaaagaaaacaaattttagctgattatattttagaacataacggaattaaagttgatgttgatagcatttttgatattcaagtaaaacgtcttcatgcatataaacgtcaattattaaatgtactacacattattgatttatattttagaatgaaagataatccagattatcgaattgaaccaagaacattcatttttggagctaaagcggcaagtggatattattttgctaaaaaagtaattaaattaattaatagtgttggtgaaattgtaaataatgatccagaaacaaataaatatttaaaagtagttttcttggaaaattatggggtaactttagctgaaaagatcatgccagctgctgatgtttctgaacaaatctctacggctggtaaagaggcaagtggaacaggtaatatgaagttcatgatgaacggtgctattacgcttggtactttagatggtgcaaacgtagaaatttcacaacgtgttggtgatgaaaactgcattatctttggtatgaaggatcatgaagtcaaagatctacaaaatagtggtacttataatgcttgggatatttataataataatccgcaattaaaacgtgttattgatagtttgatggatggcacatttattgcaaaccgagaagaatttagagttattttcgaagaattaatgaacaaaaatgatgaatatttcgtattagctgattatgatgcatattgcaatgcacaagcaaaagtaagagatctatatcaagatcgctctcactgggcaaaaatttgtttaattaatattgctaaaagtggtttcttctcttcagatcgtactattcaagaatatgttgatgatatctggcatttagataaagtgaagttttaaaaatataaaaatttaaaagagctgatttataaaatcagttcttttatcattatcatcaatataagtttaccaggcgtaatttctttgcaaattcccaaaactgttgggagagtaagagtttaagagatttttatatgaaattattaaaaatagaatatagctggtaaaaaaatagaaaagtgttgatatataaaggttttgaggtataatagaacatgtaaagtggcttatttactaggggtttaataacaacataagatgtattgaaacaattttgttagaatttttattttttcatttttataaagtttaataacaacataagatgtattgaaactagaaataactatgatatgcttgcagggttcaaaggtgtttaataacaacataagatgtattgaaactactgttctaatacatagtaatttttatagaccaagtttaataacaacataagatgtattgaaacgatggattattaacgtttttctcgatagaattcacgtttaataacaacataagatgtattgaaacccgggatttgaacttaataaagagcatacatcagtagtttaataacaacataagatgtattgaaactcaattataacaatacctccgttccatgttgctaagtttaataacaacataagatgtattgaaacttttgaatatcatataaataatatttttccattctagtttaataacaacataagatatataagaatttaattagttttataaaaaatataatatgcttgtgaagccttgtttaggggcgttttattttttattattgataaatattttttgaactcaaaagatgtaaatagattctttattttaatttttgtttttaataaagaaaaaacttatactttttggttatttagtttaagatataaataataagtataatttgacctgaaaaattgtataataaaaggaaagataagtaacgtttattgcattgccttagttaaaaatataagatataatgaggtagaaaaatggggtgaaattatggaaaaaagtgccgttagaatgattgcacaagtagtagctttgaaaaaaatagaagtattactcttgaaaaaatattatgaaggtaatagcccaagattttatttacgtgatttaaatagcggtgatttaaaagaaataaaaatttcaggtaagtatatagaagaacaatttgtacattactatttcgatgatattgaaatagatttttgtcatgtttatcaaattgttgatgcttatggattaacagagatactgcaatatactaagcttgtttgtgaccatgaatttttaaagcaaaattattatgatggtgatgatttagggtgtcactatcgccctggatatacaacatttaaagtatgggctccaactgctttgcagatgaaggtttcaattactaagaataataatacttatacatatgaaatgcaaagagtagataatggtgtgttttatgcgaaagtatctggtgattttgataattgtcagtatgtatatttagttagacatcatgagggtttctaccctgcattagatccatatgcatatagttcatcttcaaatagtttaagcagtataataatagatttagataaagttaaaatagatttaaatcgtgacaagcttccaacattagtaaataaaacggatgctattatatacgaggttagtgttcgtgattatacaatgtatgaaaatagtctaagtgcttataagggaaaatttaaaggaatatgtgaagaagggttaaagaccaagcatggtaatagtgcgggattagattacctagttgaactagggattacccatttgcaattaatgccaatatttgattttgcaacagttgatgaaaataatcctgaattattatataattggggctatgatccagctcaatataatgttcctgaaggaagttactgtagtgatccaaatgatggttatagtcgtgttgttgaatgtaaggaaatgatttctaaattacattctaaaggtataagagttgttatggatgttgtttataatcatatgtatgatgtaaatgcaagtgcgttcgaaagattagtacctggatattattttagaaaaaatcatgatgggacgctatctaatggttcgtggtgtggtgatgatttaaatagtcaggaacatatggtaagaaagtatattcttgacatgtctaaacgctggcagcagttttacggtgttgatggttttcgttttgacctgatgggaataattgatattactacaattaatcaagtttatgaaatgtgttcaagctatgataaatcattccttatctatggagaaggctggaatatgccaacaaatttaccagatgaaaaaaaagctatgcaggacaatcatgctaagatgttaaatattagtttttttaatgatgaatttcgtgaggtcataaaaggtggcagcggtgattttgttttggtgaataaagggtttattacaggaaatctttatgaaacagaacatgctaaaaatataatctctggattaaatcgttactcaaaaccagatcagtcagttaattatgttgaatgccatgataatgcgactgtttttgataaattatatatatcaaatgttgaagaaggattatcgggaattttaaatcgtcagaaaaatttgacaatcatgacattattagctcagggaattccatttattcatgcaggacaggaattttatcgcactaaaggcggaatatataattcgtataatactttagataatataaattgtataaattgggattttagagatatctataaagatgatattgatgatattaaaaaaataattcagttacgtaaaaacaataaatgttttcgatatgcaacaagagaagaaattgaaaaaaatgttttagttgaaaatatagattataagatggtaaaatatacactcaaacaagatagtggagaatataaagaatttataatttatattaacccatctagttttacttttgattatcaggaaaaagaatatagttgtatctatggcaatataaatgatagtcaaattggacctaaaactattgttgttctagcaaagtaaaggagaagtaaatgaagttaattgtaggattagggaacccaggtagagaatatgagggaacccgccataactgtggctttatggtaatagataaactagcagagaaattaaatgttagtgttgatcaaaataaatttaaaggtttatatgtaaagtttaaatatcatggtgaagatgtaattttattgaaaccgcaaacatatatgaatctttctggtgagtctgttagtacattgatgcagtttttcaaaatagaaatagaagatttattagttatatatgatgatttggatatgccagtaggtaaattacgattacgaaaaacaggtagtgctggtggtcataatggaataaaaaatattattgcgcatttaaatagtcaggattttaaaagaattcgagttggtattgataggcacaaatatatgaaagtggttgattatgttttatcacgttttaccaaagaagaaaccgatgctattaatcagggaattgaaaatgcagttaatgctattattgactatcttgatcatggtttcgattatataatgaatcggtacaattagaggcaattatgaaacagttagatgatattttaagacaaaataaggcttttaaaactttattgaatggtaaaggaaacatcattgttaatgatattaatgatgaggcactattaatatctagtgcctttttgacattgaaaaaggacattgtagttgtaaaaccaaaccagtatgaagctaatatgttatatcagcaaattatgtcaattaatgaacatgatactttactattcccggttgatgaatcatatcgtatagaggctttagcagcatcaccggaattattaggtcaaagaattgatactttgtatcaattaactacagataaacctaaaatacttattacccatagtcaggcattagttcgatatttaccagctaaacaaatatttaaagaaaattgtttggatttaaaagtaggaatgcaaatagatatttatgatttacaaaaatatttattaaaagcaggttatcaaagtgctattagagtagatcagccattctatttttcaaaacgtggtggagtaatcgatgtattttcaattcaatatgaaacaccagttagaattgaattctttgatgatgaaattgataatattcgtttttataatcaaaatagtcaaagaacaatagaaagcgttaatgaagttacaattattcctgctagtgatgtattatatgatgaatcagaagtacctgcagttattggcaaaattaatgatttaagagataaacaagcagaagaattagatgaagtatatttagatgattatttaaataaagtttctattgatcaagaaaatcttcgtaatcatgatacaagttttactatgtataactattttaatttatttagacaaacagcaagtattaaagactatctaaatgatcctttgattattcttgcaaatagtcaagatattaattttgcttataagaattatcttgaagaaaatcattattattatcatgaattaataggaattggtaaaagtatagagggtttgaatttatttagaaatctttatgaagtaattgatgatgctgtaattgattttaaatcttttgcaacaagtgaaaaagatgttttatttaatgctcgagcagttatgattgataatcaagatgaaaaaatgctaattaatcaaattagaacatatttaaaattatctaaagtagtaattgctttagatgatgagcatcaattacgcttaatatgcgaattatttgatcgttatgaattattatatacattggttggaattaaagatgaattatacccaggattgaatattacaattagtaaatttggttttggaatagaattaattgatgaaaatattgttataattagtgcaaatgaattatttaaaacaaggaatattaaaaaaccaaaatattttaaatacaaaaatgctaaagtattaaaagattatcaggaattaaatgtaggagattatgtggttcatgataactatggaattggacaatatttaggaattaaaactttagaggtgcaagggtatcataaagattatttatatgtagcatatgctcaagatgatacattgtatattcctgttgaacagtttaaattaattaggaagtattcaagcggtgaaggcaaagtacccaaaatcaataaattaggcagttcacagtggcaaaaaactaaagctaaggctagaaataaggttgatgatattgctgataaattgattgaaatttattctgctagaatcaatcagccaggttatgcttttcctaaggataatgatatgcagcttgaatttgaaaaagcatttgggtatgagttaactatagatcaggctcgttctgttgaggaaatcaaagcagacatggaaaaacctcagccaatggatcgtttgttgtgcggggatgtaggatttggtaaaacagaagttgcactaagggctgcctttaaggcaattttgggtaacaaacaggttgcttttttatgtccaacgacaattttatcaatgcagcattataaaacaatgactgctagatttaaggattttccagtaaaaatagcattattgaatcgttttacttcaactaagcagaaaaaacagattctaagtgatcttaaattaggaaatatcgatttgctggtaggaacacatcggatattatctaaagatgtcatttttaaagatattggtcttttatgtattgatgaagaacagcgttttggagttaagcaaaaagaaaaaattaaagagtatcgaaaaacaattgatgttttgactcttacggctacaccaatccctagaacattgcaaatgtctttgatgggaattagaggattatcacaaattgaaacgccacctaaaaatcgtcaaccagttcaaacttatgtaattgaaaaaaataatgttttaattaagcaaattattgaacgggaattagcacgtgatggacaggttttttatttatataatcgaactaatcagattgcaaatgtagcatataatattgagttaatgatcccaggggctaaagttgcgattggtcatggaaaaatggataaaaatgaattagaagatgtaatgatgcgttttgtaaatagagagtttaatgtacttgtttgtactacaattatagaaactggaatagatattcctaatgctaatacaataattgttgaaaatgcagataagtttgggttaagtcagctttatcaaataaaaggtcgagtagggcggagtgatcgaggcgcctatgcatatttgttatataatccagctcatgtattgaacgaagaggctagtaagcgtttaaaagcaattaaagagtttactgaattaggtagtggatataaaattgcgatgcgagatcttgcaattcgtggttctggggatattttaggtggtacacaatctggttttattgattcaattggatttgaaatgtatatgaaaatcttacaggatgcaattaatcaaaaaatgggtaaaaaagaagcagaggaaaaagaagttagaagtgttaatgttaatgtagaagggtatattcctcatgattatgtttctagtgatattgaaaagctggaattatatcaacgtttggataatactaaaacaattaaagaaattgatcatttaaagagtgaatttattgattactatggtaaattacctaaagaggtgattgctttgattgaaaagcgaaagttagatattttagcagcctctaaaattattgataagttagaagagaaaaaaggtaaaatggaaataacttttagcaaagaatatagcaaaaatgtaaaaggagatcagttgtttgaaacagtaaatcgtttatttactagaccgatgtttaaacaattagataataaaattatgattgttttaccaaaaggtgatcaatggttagaaaggatgaatcagcttattactgtattgaatcattagatatatatattgttttaggttatttgaagatattaaattggcatttgttattgactgaaaaacaaattcctactaatcatgtaactattggtaaatacattaaatatttgtgcaatgcttttattttttatgatatcaaacgatatgatattcgtggtaaaaaatatcttgaaagctctgaaaagttttatttatgcaacacaggtatccgattcgcaatacttggaagtagaaatatagattatggtagagtttatgaaaatatggtttgcatagaattacttcgttggggttacgatgtatatgttggtaaactttaccaaaaagaaattaattttgttgctcaaagaaatagtgaaaaaatttatattcaggtaagcgataatattttaaatgaagatacattcaaaagagagtattcttcattacttcgaatcaaagatgtatatccaaaaatcatcatagctagaactagacatcctaaatatagctatgaaggaattgaaatcattaataatattaaagattggttattaaaagtataaatttgaatttgtttgttgattgataatttttatgggagataagataaatgagaaaaataaatgatgtttatattatgaatatttcaaattggggtggaaaagaataagaacatactttttctaataaatagactatgaaatttaaggagaataatgaagtatgaataaattaactttaagacctattatgtctgctgaagataaggatatatttataagtgaaattcaggaagcttttcaaaaatcttatgtaaaagaatttggagaatttgaaaaaacaattcttccaataaaagatattgaagaatcatttgaaaccaaaggctcagaagcatacattgcagaaattggcggagtaagagttggcggtacaataatagtaataaatgataaaactaggtacaattcacttcatcttttatatgtgaagtcagacacacaaaatgttggaaatgggtttaagatatggaaatcaatcgaagaattgcatcctgaaacaaagatttgggaaacgcatacaccatattatgataaacgaaatattcatttttatgtaaatcgttgtggtttcaagattgtagaattttttaatccaaagcataaagattcacatcaaacaagtgatactgctggaaatattccatcagaaaacaattacttttttagatttgaaaaagaaatgaagtaaataaattagaatttaaggtgaaattatggcgtcaagtaaagaatatttggaatttattttagggcagttatctgaattagaagaaattacatatcgtgctatgatgggagaatttattatctattatcgtggcaagattgtcggtggtatttatgatgataggctgtttgtcaaaccagtaaaatcagcagttagttatatgccaacagctttgcatgagttaccctatgagggagcaaaagaaatgttgttaattgatggagttgataataaggcttttttgacagatttgtttaatactatgtatgatgaattatcagcctcaaaaccgaaaaagaagaaataaatttttcattagataaaaaactatactctttgtttatttgggataaatatttttttattaaaataaatatattgaaaatgattataaaaatagagtaaaaacttaggcttattttatcctatgtttttactctattttttgttaattattattataattgtttaaaattgtatcaaagtctaaacctattttaaatcctaatgtaaaataatcatcgatacaattttgaaaagcttcaaaactgtaagtatcaattacttttaaggcactttgataaactttaatcagttgatcagcagcattattagtatcactaatttcttgataattttttagattatcgacatgcaattcaaatcctacagacattaacatatgtaaaccgtcaatataataatctaatagttctttatcattagtagaagaactatcccaaaaactaaatattttggactcttcactagcttttgctaattcacaaagaaaagctagtatcttagttttaactttatctttgtttaaaacactatgatcaaaattattaactaattttaattcattagttacatgttcttgataaatcttatttatttcattcattatagtaatcacctcttaataattattatactcatctttatgacattttaatgaattacgataattctatatagtcatttctaatatatatttttttatatgtattattggttaaatcctggatgatcgataaaaacgattcatcttcaagataacaattatagctaacttgttcaagatattcaacattaatacattttattttatgcactttaagtaaatgctcgaattttttagtatatgaataatcaattgttattttgtataatggtacactgaatttttctacgatatcagcctcttttaaagcatcagcgacactttgacgatatgcacgtgttaatcctccagcacctaatttgattccgccaaaatatctagttacaatagcaataatattagttaaattatttttttctaaaacatctaacataggaagaccagctgtaccactaggttcaccattatcatttgctcttttttgatttcctacaatataagcaatacaattatgagttgcatcatgatatttttcttgatattgatgaataattttgtcaatttcttcttcatcattacaaggaatcaaagtacaaataaactcggattttttaattacccatttataagttgttattttacgtatagatttcattaaatcccccatttctttattatcataacatatattactagaaatatgatgataaatttgatatattagtagtataactataggagggaataattatgagtagaatagcagttttagcagatagtggatgtcaattgccaattggctcattagaagagcaaggtatttatattgttcctttaacaataactatgaataataaaacgtatttagatttagaagaaataacagctttagatgtttttaatagaatggaagaaactggagaaatagttaaaacatcacagccttcaactggatcgatacaagcagcagttcataaaattaaggaagctggttatgatcatattattgctttatcaattgcaacagggttatcttcaactttaaatggaatgaagttagcttgtgatatggtagggatacctgttactttaattgatacaaaaggtacagctagtaatcatcgttatttagttagggttgctaaaaaattgatcaatgatggtaaaagcatagatgatattggaagtatcttaactgctatggtagagcagtcagggacgttgatcatggctccaaatttagatcatttaaaaaaaggtggtcggattactccagcagttgcaatgctgggaaacttattaaaaattgttccagtaatgaaattaaattataatcttggtggtaaaatagatactttagataaagtcagaacaataaaaaaagcaaatttaaaaatcattgaacatatggttgaagtatgtggtgttaataatcaggattatattattgctattgaacatgtgttagttgatgaattagcacaatcaatgaaacaagcattgattgataaaattggaaaatgccaggttatagtaagagagttgcctgctgtggttggtgctcatatgggagttggcggagttgggtatcaatatataaaaaaatatgagggtttatcatggaacgaataacaagttttagtgtggatcatacaaaattgacaaagggagtatatgtttctagaatagatggtgatttgattacttatgatattcgaatgactgaccctaatgttgagccggctttggatcctaaagcagctcatacaattgaacatattggtgcgacattacttcgaaacggcagctataaagataaaattatttattttggtcctatgggctgtatgacaggtttttatttaattactaaagagttggatttaaaaatagttaataatttagttaaagatgtatttagacagattgctttatgggatcaagatattcctggagcaaaagctgaagaatgtggaaattatagttttatggatttaaataaagctaaggagtcagctaaatattttgttgattcaccatggcagcatgagtattattatttataattaataggtaaaatattataattaagagataatattttactttttttttaatattcatacttgtatgaatatatagacttaagtcagttgagcatacgaagtatgcgaaataaaaaaccacctgctatgcgggtggagcgataaaaaagttatacaaatattcacctttccgatatatattaaagttgttcaagctatcatatatgaaaggaaaggtgatagaagtatggctcaaaaagcaaattcattggcacatacaaagtggatgtgtaaatatcacatcgtcttcacacccaagtatagacgaaaagtgatttataatcaactaagaaaagatataggtgaaattttaaggacgctatgcagatataaaggagtggaaataatcgaagggcacttaatgtctgatcatgtacatatgttagtaatgattccaccaaaggaaagtgtatcaaagttcatgggatatttgaaaggaaaatcagcattaatgattttcgatagacatgcgaatttaaaatataaatatgggaatagacatttctgggcagaaggatattatgtgagtacagtaggattgaatgatgcaacagtcgcaaagtatataagggaacaggaacgacatgatattgcgatggacaaattgagtgtgaaggaataccaaaatccattcgaggataaggaaatagaggaagaaaagaaaaaacaagaagttaagaagaaaaaagtaaaaaaatgaaaataatccctttgagggatagcgagagtcaaaagcaatagcttgagcgaagtgaaagcagcgccttgagacgcgagcaagtaacaaaggcttatagcctcagagaaaaccacgtcttttaggcgtggtttttattgtttttcaatgtttgctcttacatgttttgctggcttaaagaattttaaaatttatactgaaattaagttcatgaaaaatatgaaaaagggaaaataatgaatttaaagaaaaggattaaaggccagtgtcattaagttaagcatcaaaatacaaaaaagttctttaatgaaaataaactggttccaatgtcaaggccaatatactgacagttatgaataagttatggaatgtgatgagaatggagctatgttttaagccatagcttcatttttcacactttggtggtattttgttgtagctaaaaaagtgcacttttttaaagtacattgttatactactctaatttttgttgtttacaatatcgtatataaccagtcattaatacaagtaaatttgtgagtttattagaatactaaatatatattgacgatacagttggctatatcacagatgcaaaatgatttatggatatttattaaacctctttttagtttctgtataaaacagctaatcatgttaatataaatctgccatatcattgacaaattttagtaatgatacatatgaatatattttagctgttgaagaagatacaaaagcaataaaagtggcagtagattatgatggtaagacaaaattaatgttaacaatgatacattagtaggaaatataatttcatagaatgatttaaggggtagaattaatgatggatatgttatggcggcagctaatgatggtattacaaaaagggtttatcatattcaagtgattaaaccatataatcaaaacacagaagtattaaaaatagaattagataatcatgaaattacggataaatttaatgagcagggaaatcttaaaactattgtttataatgatcaagtggttatagatatagtatgtcaagacaaccaagctctaatagaaattagtagtggtaaagaaagatttgaaaagatgggagaaattattcaatcaataaatatttataaggaatcaccagtaattgatattgtaattactttacctgatggtaattataaggaaaagtgtcatcttgatttacaaaaagcttcttatctgtcagatttaatatggaatgatagtgcaacagcaggttatggtgagattcaaaaagataaagtatcaagcggcttagcaattcgtttaccagatgaaaatggtaatccagttagatttgataagggaattggaactcatgctcaatcaattatttcatatgatgtagagggtaaaggatattagcgtttataaggatatgtaggaatagattatgctaagtttaatgatggttatgatggggtacagtttgagatatatggtaatgacactaaatgatttgatagtggcataatgttaagtaaaacgccaatgaaatattttgatgttgctgttgcaaaagtaataactttaaaagccttacaaggggataataattggaatgatcattcagattaggtagatattaaatttacttcagaatttatgacaacatcaattaaatattataatcaaactatattgcctagtgaaaatggtataattacttcaagcattcaagatgatttaattgaggaaaatacatttgtaacatatacgtttacatcaaatgatggttgttctttaaaagaggtcaaaattaatggtaatactgtatcattagataataatcaatatacaatcagtgatgttcaggaaaatattgatgttgaagcagtttttgaaaaaaacagttttgaaattaataaagatgctttatcaattgtcatcgaaatggctaaaaatgctgatttagaaaaagtcgtaccagctgtagttaaagaattcaatgaagctttaacaaatgctaaagacgtatatgacaatactaaggcaacacaggaatattttagctaatgaaaatgcaatgcaggaagaagtaaatgaaacatatacaaaattaattaaagcatttttagaactaagatttaaaccaaataaggatttattaaatgaattaatcaataaagcaaatggattaagtgaagcaaattatacagcatcatcatggaaagtgatgaatgaagtattgaatgatgcaatagtagtattaaatgatgcagaagctaatcaagtagaagtaaataaagtaaaagatgtattagtaaaacgattagcaggattagtggcggattcagcagtggaaacagtaaaaccggaagataaaacagcaagtgtaaagactggtgacgacagtgtgattgctacaacaattacattaatgccattaagtttagctggatattatatttttaaaaagaaaaaattttagattagttcttataaaattttatagaaaataaaataattcaggtaagaagtgtgagtgttttgcacttcttattatttaaaatgtcgagtatgatgaatttagcaaagtatgaataatattgtaagtagtagttgttagggctggtgtaattagttagacagacatcagtaactagtttagtgataagcaactataaaagtttttgggaatgtcaagaaatttgtgtaagtaattttattaaattgttaaagttctatagaaatgacttatatcgagtatatataggtcattttatttttctaaatatttttgaattcttgttgagaatctatcatccatcattaattgattcataatcattgaccaatttgatacacgccctcctgaccatttgaagtagataacatataaaaagaacgttttatgtgcttctaattagcacttcttgaaacgcttttttgtatttttttgttaagttcaaccttgaattgtttgtcgatatcatcaattacctcatttctatagatgaaataagctatatatcttatcaatattgactatatctatatagctttttatatgtttgctgttgattatatactttataaaaagtagtattggttaaattattgtgtacatacagagtctaaaaatagtttataaactgctaacacttagtacagaggataataatcctcctgataaaatcatggcgcatacagatataataaaaaacataatcattaactatattatggtgttgaccttccacaattatcataatctttgatataattctttatacaattacaaatattttgcttgtgacttctattgaccacaagcttttttgctacataaaaacagcctcaaagtacatcttggtcattattacaacaaaaaagcagatatgtacagaaaaaattatttattcaaagatgtatgtgtttattttaatcatgtttctaatgaattaaattcttatttttcaaaactctatgaacttgatttcaatgaacaattaatacgttatatatcatatatttagacatgattatttagtggtgattagactatatttattattgatgtgaaagaattgttatgataatgattcgttattgacaggttatagtggattaataaaattacaaaactttaacaaagatgtttatttatttttaaataatcacgatactaatttttaaagacgaatttataaaaataagtaccaaaaaatctaatgaaaatagtatacaagtgtacagtaatgttttttgtgtaaaggttactaaattcttacatattgtgtgagatttttcttgaaatttatatttatgttattgtatattataggtgtggcctattgacatattttcatataaatatattggtatttttagtagcagaaaatatgatatatgtatttgtaaaatttgatgattaggtacataattttggaagaggaaggagtatgattaattgaaacggaaagtatttgcattactattaactttttgtatgatgtttcaaactgttgtaggtgtaaatgcctttgaaactaatagtgatgaaacagaagatcctatttctgaaataagaacaattgataattcaacaggaattagtgaagcttctgatgaaagtgcaggtaacgaaacaacagacgttacaaattttgaattacaattaaaattagattttaaaatatcggtagaacgattagaagatttaatgggaatgtttagagtttgtttgcaatctgcagacagcataaataatggagaagatgaatcagctaatgatccacttaatcatccagaatttagtgctaaacatgttcatgctcacattgataactacaatgaaagtatgattgtttttaaagctgaaaatgtggagcctggagaatacagattgacattggaaactgaatattttttccaagatttttcacaaaatataactataaaaccaaatacaaaaactactttagtatttagtaataactatgatgctgtattaggtggtatgggtgtatttggaattggtgatttaaatacagatggattgattgatgaaaaagatgctaatattttaattgagcataatggacacaaagtacctgatcctattcaaacaccacctgaagcaggagataatgagggaacaggagaacttcctccagaaactaatccagatcatgcatttgaatatgtatatgatttaaatcaagataaagttattgatattgctgatttagcaattcttgttcataatcttgatcaggaaacaaaaccagcagttgcaattgaaactttattgccaacagcagtaaaagtagaagctaaacaagaagcagcaattccacaaggagaacgtactttgagttcaattatggaagatgctgaagaaccaattcggttggctcctaaagaagatgctgatatttctgaagaaaatccagttaaaatagaaatggattttgatgctcaagatgctaaaactgatggaattgttatttcagctcctgctgaaacaggaccaactggtggaactattgaagtagaacaaatcactggtgtaactgaagatggagtggaagaaacagaaactattaaaatacctatcgtagatgaaaatgcttcaactccagctagaaaagctaaagttagagctgttgctcgtgctggggcacaagcaattagaaaagctgatggtagtattgttattgatttaggtcaacaaattgcaattaagaaagttacaattgtagtaactgctactgctacaagtactaaattaactgaaattgcaaaagttgaattcttaaatgatatggaaacaagaattccagaacctgaattaaatgtacctaaaaatgttactgtttcaggaaaaggaaatcaacttactgttacttgggatcaagaacaaaatgtaacaggttatgaagtatcaatttatgcaactgatcctgaaaataataataaaagggttcctgatagtggatttaatacatacagagctggaataaatcaaattgaaattcaggaattcaaaggtggaagaaaagataaagttacttcattatgggattaccatgtctcagtaaaatcagtaaatggtgactggtcaagtccatattctgaaacagtaactcatcatcaattagccggaggaccaccaccagctccagatatgttaaagattaacagtaaatacagacaattagatgtttcatggaaagacatggaagatacagagtattatactttagaatatcgtgaattgggaagtaatagtgaatttattgtagttaatgatatcaatataaacgcttatacaattacaggtttaaaagacgatacttcatatgaagtatatgtttcaggatggaatacagatgataatggtaatccaagacacggaccacgttcattaccagctgtaggaaaaacaattaatgaaattcctaagttccagaaatataaaatgattaataacgatattaaggatataaaattaatttatggtcttggaggaactagtgactttaatcctagagatcttgtagatggtgattattcaacatatttcttcagagaattaggttcaacttttggggctgatgtaacatttaatgagccacacaaagttaaagaaattattatgagtaatcgtttggaagatcaatatcgtgatgctgctaactgggattattcaggtttatcaattattctgtataatgaaaatactgtagttgataaatttagtttaggtcaagtagctcaacaaagtttgcatccaacagcaaaaaatacgattaaattcattttacctcgtgcggtggaagcaacaagagtagagtttaaactaataaaatatggttttgcttgtacgactaaaggaaattcaatttctgaaattaatttctttgaatatgatagtttagaagatgatgtttataatttatatgcagacgatatgcatgtaacacttaaagatgaaagtattgctaacgaagcaagaattgctgaacttgaagaaagagcaaatacaatagatgaaattaacaatgaatatcatccaaagaaagatttattattaagtgagttagataacgctagaaaattattaactgatggaaaagttggcggtacagtaagtgttagtccagatgtaacattagaaggtacaagtagattaggatttgctggtggtctaagtggattacagccattaggatacgtagcaaaatcaggagatacagttaatgtttatgtaggacaaaaaggaaaacaaattggtgcgacagtaccagtgcgtttagtatttacacaatatcacccagaagcatctgcatggagatctggtgaaattactttaaaacaaggtttaaatgaaattgaaataccagaagtatctaacttgggatatgaaaagggtggatctttatatattgttcaaactaatagtgcagatataagaaataacccagttcaggtacgtgtaagtggtgcaacgaagattccacttcttgatttacatagaccagttggggatagtcgaagaagtgaaactggttggcaagaaaaaattaaagcttatacagatgaactagaagaatatgtaaataatctagaatctaaacataatgagttacattcagatattcaaactttagatgatggatataacgaaacaaactgtttcttaaacagtacagaaataggtgtggacaacgttttaatttcacttccagcaaaaacaattttagctggattaagggaacaactagcaaatggtaaagctaagacacttgatgaagcaatgcttaattttgctagagcaatgaatcaaatgttagagttgttatataaggaaagaggattagcacctcatcaggcaaatggtacacatggtactcctactgcacgttttaacattcgctaccatagaatgtttgcaggagcatttatgtatgctggtggaagccatttaggaatcgaatatggttcttctcgtttgacttcaaataatggtcttcaggtagacgaaaatggtaaacctggagaaggtagtatgtttggttggggtattgctcatgaaatgggtcactgtgctgatcaaggtggtgtaactattgcggaagttaccaacaatatttggtctcaattcgtaaaaactagagatactgctgatacatcacgtatcccttatccatcagtttataaacatgtaacttcatcagctgttggaaaacctactcaagtctttgctcaattaggtatgtattggcaattacatcttgcttatgataagaattactctcattatgattattataaggatggttataaccaagctaactatgaaaatatgtggagaagcgaattctttgctcgttattacatatatagaagacaaatggatcttgcacctaaaccaggtggtgtagctcttacaaattctggaagtgtagatcaaaatattatgcgtacagcaattgctgctgctgaaagagatctaactgatttctttactgcttggggatatcagatggatgctggaactcaagcttatgcaaaacaattccctaaagaagaacgtaagattcaatatataaatgatgctgctcatgtacatcaattgagaaaaggtttcaaaatgacttcaactgaagtaaatgctgaattaattcaaggaaccggagcagatgcaaagaaagtaacatttaaattaagtttacctaatgaagctcatagagaagcaattttaggttatgaaattattagaaacggtaaaccagttgcttttgtagaaccagatctaacagcagaagatggtgttactgtatacacagatgtaattggttctgaaaataaccgagttatggattaccaagtagtagcttatgataagtatttaaatgctacaaattctaaagtttttgattcaattaagattcgtcatgagggtgaattaccaagtgatgattggacagtatctactaatgcaatttctgatgccggtgtattaacagtatatgataatacaaaagttgtagaaggtggagtatataaggatgcaatttctggtgaaagtgtcacatataagaaaaatatgggtataaaatacctagaagaagaaactggagaagcattagaaactgtaagtgcttctagattaattatagatggtgatacaaatacttcatttgttggttctactccaaataattcaacagcatggtttgctattaatttaaataaaaaacaaaatgttgtaggaattaagattaaatttgaaaatgattcagaagaaatgtcttataaaactagagattgggcattctcacttgagtatagtactaataatggagcttcatatacaagattaggtgcatttgaatttagtaacagtagtaataatgttgctcatcaagatgaagcaggttataagattgcttactttaaaaaggcaggaaatgataaaaatatttatggattagatgttactaatatccgtttaacaatgggtaatgcaagaccaggagataatccaaacaaaattggaattacagatattaaattattaggtcaaactggagacaatgttgatattggtatttctcatattaatgatcaaggtagagaagaatggaatactaacgatactattggtatcttagctaatgattatattttagatgaagctaagggtacaaagattcctgctggatcatttattgttactggacaatatacaggaaatgctgcatataatgttgttaaattatataacgaaaaacatgtaatgcatgatgatagtgttgaaaataaagttaatagtattatcagtggatatcaagcattctttgctgaagtgccagaaactggaagcattataaatgttagaaatggtacatggatttactggttagaaccattaactggtgaaaatgaaggtaaatttggtttaccaggtgctggtgaaaacggtagtgattttgttgtggaattaccaacaaaagtatatgctgaattatatcgtgtagataacgctacgacattagctggtgaacgtatggtaagtgatagtttcacaattgatgtaccagctacattacctacaatcactttaactagtggtggacaagttgaaaaacctgttgctgatccaattattgctgatgttggagaaaaggaagattaagaaaaaatataataacttagaaagaagaaattcttctttctaggttgtttagtaaaaataggaggaatacatgaaaaaattaaaattaatggcactatttctttccgctactttagctttttcagcgattattcctgtacctgtattcgctgcagataaaacagaaacaggagaaacagaagaaactgaaaacaccccagttccatatattttaagaactgaagtagctggggaatatgtcaataaccaggcaaatgtttggttagagttaaataagaaaaattctgaaaatattgccgcatatcaaattaatttaagattaacttgtgatgatggacaaatgttggaaggttataaattagatttagagtttgatgaagcattaaaagatgctagaataaaagatgctgaatttgatggtgcaacaggagttataaaaatcatggttgcagcaactaaaaacttagtaaagattgacggtgacagtcataaattaccaattggtaaaattactttagttcgccctgatgatgagactattttacaaagacaatttaaaattactgtcgatggaaatactggtaattttgtaacagtaggaactgataataaaagaactgctgctagcgaaaaatatggtgaagatttccaaatagtatctgatggtacaatgttaggtgaaaaaatcacttatccattaacagtaaaagcttcaaatggtggtactgtaagaattgtgacttctgatgaaaatggaaatgaagttgaagtaaaagatttaacaaagattgaaagaggaacaactttaaaagtaatccaaacggcaaatacaggttacagatttgctggaattgaagcagttgacacttcaactaatacgcctatgacagtatctggaagttttacatttactatgatgaatcctgttgatttaactgtcacttttgaagagatgaatgaaaaatttaatgttacagtagataatggtgatggtgaagctatagttagtgaatattcaaatagagaagtagctagtgttactgcaggaaatgttgaagggaaaaaattctctcattggataaacacagaaactgaagctattgtttcttatgataaaacatataagtttattgttttgaataatattagtttaaaggctgtatttgttgaaaatacagaaactattgaaaaagaaccatttgttactatggatagtaatgttactacacaagctgtgggtgagaaatatcgtattagttttagtggacaattctatttaccaaatgattgtacattaaaagagtatggaatggtacttacttctaatgaaattacaaatgctgaagaaattactaaggataatccagaaataaaaaaacaaatagttattgctactaataaaaatagtgtgaatcaatttgtaatgaatattaatggtgtaaaacctggtgcaactagaaatggccgtatgtacgtaatttatacaaaagatggtgtggatgtgattaagtatagtgatacatttgcacatattaaactacctacaaattaaaatgaaatatggaggataagataatatgaaagaaatttatgaagtaccttcaattgaagttattaaatttggaaatggtgattcagtaataatggagactcttagtggagttgtagataatgaggcaggggatgaattagattaatttattatatatacgaaaaggctactgcaaatttgtggtagtcttttctctaaaaaatgtataagcaaaattattagtactatgaaaatgtttcacaggtaagttgaaggattgttgaagtatgattttgtacaatatctttgtgtaatttattatattataatttaaaattttttgaatatactttataacagttaataactggttgactatatgagtattaatactgtaatggaggaaaagatgaaaaagaaaattttagtatgtctagcaatattgcttgtttgttttggaataacaggttgtcaaaagaaagacgatagtaataagttagataatgatatgggtgaggtggataatgaagctgctgatccatttgacgaataattggctttgggtgtttagcatcctggccttttttgtaaataaaaataccctttatagggtatcgaaaaatatttttccattttcaactttaattatttggtcacagcagtgaattgcagctaggcgatgagatatacataaaactgttttttgatgaaagtttttaagattaaagagcagttttttttctgtttctatatctagtgctgatgtacattcatcaagtaataagatgggagcatcatttacaattgctctagcaatagcaatacgctgtttttgcccttcagaaagtcctattccatgttcttttaaacttgtctctataccgtttggtaattcgtcaataactgtatctaaacaagcaatttgtatagctgatttaatttgttcttctgaagcgttttgatttccaaagagaatattttcacggatcgtaccagagagaatcatatttccctgaggaacgtaagaaaatagatttcttgtaccagcatcaattttaatattttcatttttagtttgaattgataattcaccggtatttaatttaattaaacctaatagtaaatggaataatgtggttttaccatttcctgatgatcctattatagcagttactttaccttttggaataaaaatagatacatcttttaaaacgcttttttcatcataagagaagttaccatgttttaaactaatgccttccatattttgataaaatgtttcaagatcaataattttataattaacactttcatctcttagaaattcgatttccatcaatcgctgggctgatgcaatcatactatcatattgaggaattaatcctgaaacattgcgaaatggggccttgatttgatctaggatttgtaaaaaagccattaaagtaccaaaagttaaattacctttagaaatttgaatggcaccccagccaagagcagtataataaccagcagccatcattacatatattgatgtatgagcaatattactaattgcattttgtttaactctaattttatagttaacgttttgtttttcagataattgttcttttattgaatattcatttgtaaaagattttataacaataatgttttcaatacattcctgcataaatgaacgtacagagccttgtgttttttggatttctttatgaagatagcgaaattttttactataaagacgagtacatattacagtgatcattccaattactaatattaataaagtaaattttagatcaattgtcaacattacagcaattccggcaataatcttagtaaataatgaaaatatttgaggaatgaagttaactattccattggatacaatttcaacatcactagtaaagcgattcattaattcaccagaatgaaaagtaataatatcttgatattctttgtttattaaaacaagtaataatctttcttttaaagtattttctatttttgctttactacgaactttacagttactagaagcaatatttgctagtgcttgaaaagcaattacccctaataaaaataaacacgtattaattattgatccagaagtattatttgttgcaatatctaatatttttttagaaataacagcaattaaaataaaacttcctgaaatagccatactaatcaatgacaacaatattactaaccaaagatactttttactacattgataaatccatttaacagtactattttttaacattttttaaatacctgaatctatgcagtatatataaaataattcttctaaatgataaagaaaaacaccataaatatacatacaatcgatataaaaatgaagatgtatcaatatatttattatcacgataaaagccatccattattcctaagatctgctcttctttaacaccatactcttttataaattggttatcaccacagataatatagccatcaggagtaatttttaaaatacgatgtaaaatataacttccgctattacgcttatataacactacatcatattttttaggtggcagtgttttcttttttaaaacggtaacatctcgattagggcgtattaaaggcagcatgctagtaccaattggagctatgattagataacctttatctaatagtgtttcttccatttttttattcatctaacaaattatcttttcttaatttatcaataaataagtcaatatcttttctagcctgctgttcacttaattcatatttatccagcattgatttcagtaattcttcttttgttttatcagtttgtaactgttcccaaataaatgcaccagttgaattcaattgaatcataccattaaaatcattattttttctatttattgatactactacaaaactatctgctaattttcttaatataaaaccatcttttattttcattatttattctcctttcattttatcatatgccattaatgcggcttctttagaaatattacatttcatttggtatattggtgtttttgttaaaactatatctaacatatcaaagaaatgattaatagtgtcctggttttttggtaaaatcgtttgtttcaatattaaaggtatagcttttttaacaggtattaaatcaatactattttctttacctctttcaagaagacagattgcttgcaatgggacctttagatttagattttcatcggtcttaccactaaatggagttccataagcataacatttgccattttcaattctaattgcaggtttatcatcattaataattattgcttcatcaccaaaacatttctgccataattttgtgtgagtggatttacctgttccactatctgctgaaaataaatatgctttgttattaactactattgctgaagagtgaagcataaaaccgcctagcttgattaatttacggtaaaattctgatcctgcaaatatatattcacattgttctaatgttaaatgaggattttcttgctgttttatatcacaaaattctttagtgattgtcaattttatatctggttgctgttcagcaattcgatatgcttccatttgattctttagtaaaggataaattggttcgtattcaactacacattctgctattttataaaagttcatttttatcaagtcctgctttctttaaagcttcagctgtctctgacattttatgtttattaaaaggtgttttcattattttgataaatgcatttttatcatctataattttcacgatacctcgatgaatccaggcaataggtaacaaaaaagggaaacgatttacatatgagtatttatttttcatactttctaaacatggaaaaactatttccaataacatcttaatcctatttttaataactttattagttttacttccatcttttaatatttcattatttaaattattttggactgtgccatatgcaccactattaataatataattgattagatcatcattttcaaattgataattatcatctaaacatttttttaatatttcttttatatttttttcaaatgtcagtaaattagctttatctaaattagattcaatataatcacgattacaaagtgattctaatttgttttcaaaaactataaaatctaaaagcattctaataccaataccaccaaatttaaaatgttttgccatatgtccaaccataaaaagataataatcatcaattggcatttcataagtatattcattgtcatccactttaatgcagcgttgccaaacgctttccaataatgtatttaatgaatcattatcggtatagcaatgacgatgcatttcaactgtcatatatggttcttttacatagacatcatgatgtactccaaattcatatatttgataaccaatttctaatagggcttcttttacaatttcagctttttcatttttaaataaaatatctaaatcagttaaaaaacgcatgtctggggaaggataataattttttattatacttccttttaaagggatgttttctattttgtattcttcaaatttatctataatcatctgtaattcaaagtgttgattgatttctctaaccatacctttttgtttagccagctggaatttttgataaatattctcaggcatttttaattgttggttagatagatatcctattatgttatcaatacgatgaaacttgcataatttataaatatagtcccaatctaagttgtcttcaacagaaagtttactattagttaaaactgctttaagcatcaaaaaaacatacttttgctctctagctttattcattataatctcctaaaaataatatcatattaaatagtaaaaaagataaaacgtattattaaactattgatatataatttaatcatggttattataacttatctcaaatagttttgctactagattattcattgatttttatagaaaaaatatataaaaatcaaatataaatatctttttttttaaaagggctaatgtttactttttcaaacgaagaaatacttaaaagagaagctgtattatattcctttaaaaatttattatggttgaactatgcttatttattattattttatcggtttgcatttaaaacatatatttaaggaatttaaacaactattttttattgaggaaagaatttgaaaaagaaaaagagaaagatatatttgtatacagtcaatatatatcattttcgacaaaatgtttgttgaaatcggtaaggcttatgatgatatacatggattttaatttacggtgttttttagaaggaactatataaattaaaaattatacttatatagtctggttattgatattggaattgtatcgaaaatataacttttggttgttttatcttgtattataataatatcatcagcattaaatatgtttttctatgagaaattaatttatgactattttggcgtaataaagcatttagacaatagcagaccagataactttttaattaaacaattatctaaacattgatttattcgtttattcagagaaattcaaagaaactcaaatcgtcaaaagcctttatttatcggctaaaactcgatttgagtttttttctgtttttataaaataaaaacggtatgcaacatatatgtaacaagtatgcaacaaagttctcaccacatattctcaaatatgcaacaaaaaaacgactcaatgtgagtcattccattcattcatcttttcttcaagtaaatcaaaattacaataggcgaattttattttttttgttttcttttgtcgattaataatactaagagatttattgaaaattgtatctttctttttcttacaaaatgcatattcttttgcaagtaaatctctatctttatgggttcttatatctatttcatgatagcaatcttcagctacaggaattgcttttcttaaatcaacaacagataatagttttttaactcaccatttcccattgtttttataatgtcttttttatgtatttctgattcttcaatattttcgtaaataagcaaataatccattcctgtattttttaatttcaaatacttcatttttgttgaagttaaaggaataaaataaggtactgaatcattatatacaacagttccaacatatggtttgttttcatagtcatgtcttttcttattaaaataaacttcagaatcataagaatgcagatatttaatatagtctatatcaattgtataaaatttcaccttaattatgcccctttcttattataaaataaaaggaaggattatgcatccttccacactttaacgccctacacttatggcggtaggagccgtacgattcggtatttctaccctcgactatattatacaccataaggtgtataagtcaagcacaaagtcttgacgtatatagtatacgcgcaaatgcctataattattctgaaaggattatattttttggataatacatactattaactgtatcaattaatattttcatatcaatgtgtgtatagactttctcagtcattgtcatagcacctttatgtcctacaatcatttttgaataagtaggtgatacacctgcttcagcaggtaatgaaacacaagtgtgtcgacaacaatgtggagtttggtcaaagccaagttgttccatcaaaggtaagaagtaactatcatagtagtttctgtatttgaatggtttttgttcttcggtgtgcaacagacgatcacaatgtgatgatccataccaatttttaataaatggatagatataatcacttattgggacttttcgaataccactttctgttttggattttactatattcaaatagtgttcatttaaattgatgttttctttttttaacgaaagtaattcttcaattctaagaccagtatagataagaataatttgataatctttgtcttcttacaaagaccgaagagtatcaatatgttctttagtaaatggttttctatcatacttatcaggatttttatcactatatttagcaatatcaacatattttgaataatcttttccacaaaggtctaatttcatagcataagcaaataactggttaaatagtatttttatttttctaagtgtaggataatttttaccgcaattatcaatgatgtcttgtaaatctttcgtttttaaatctctgaatttcatttcatataactgtgcacaggaattataagcggctctatatccgttaatggtagactgtgatgcattattatatttatcttctgaccagttttcataaacttcacggaaagtcatgttgccattttctaaatcaaatggttgttcatgatattttgccaacatctgcattccctcctgtctggttttagcataaccgaggatggcatatttttgagtggatttgccactttcttcatttaaggtataaccagtggtaacacgaactatatatggttttctgcgacgagaggcattgctcatttttgacacactaccataactattcggtaattttaaaatctttgccatcaaaaatcacttcctttgtttgataaacatattcattaagaatattcatttgtatctcagtagatatatttttgagttgtgttctacttattgttgtatatttttgcagtatttcttctttttgtttttgaaatagttgttcataataacaattaagaataaacaatcgtttcttatattgcttatccttaagcaatcgtacatattgacggggataatattttttaagatattcttttctttttttggcataaaagcctaatgatggttgcatatcattaaatactggataataaatatctccaatcttttcatattgtattttattattactactatctttgcttttcataagtctttaccttctttcttattggtttttctagcatttctttcatttcttctttacctaaaatttttgatagtttacttaattgattacgaaagctttggtgctagaataaaaactgtaccaggcaaatggaagaattagtagtcctgtggtacaatgtcatgagttgattataagaaatgaaaggggtatatgattatgagtaaaccaacatttacagatgaatttaaacagggagttgttgactatgtactgcagcaccctgatgaatccaaggtcgctattgccaaacactttggtgttgctgacagtactgttcacaagtggcttaaagatgctaaaaataataatggtacaattaattccaggggcagtggcaactattccagtgatgaagctaaagaaattgccaaactaaaaaaagaacttaaggatacaaaggatgctttagatgtcctaaaaaaggctattggcatactggggaattaactaagcaggaactgtataatcaggttaagaaaaaatctgatgctgatcctaaagcttcagttaccggtatgcttgaaaaactgaatatcagtaaatcaggatattatgactatcttaaaagaaaaccatgtaatcaaaaaataagaagagctaaactagctgttagaatcaaggaaatacacaaggaatcaaaagaaatatatggagcacctaaaataacccagatacttcaaagagaaggacataaggttagtgaaagatttgtagggaaactaatgaaagaaaacaacattaaagcccactatatcaagccatatactaaaacaacaaaagactgtgacttttccagcagattacataatattctaaaaagagattttaatccaaaggcaccaaatgaagcatggtgtacagatataacttatatatacacacatgatgaaggatttgtatatctaaacagtatgatggatttatattcaagaaaaataatagcctggacattaagtaaaacactggaggtggatgaggtattaaaatgtctggaaacagcaaagagcagaagaaaaacagccaatccagtagtaatacaaagcgactatgctgaagaaaaaactataccgaagttttgataacggtataggaaaatactttaattcttcggtatagtcgcttttatactgaattcggtataataccgaagatggaactcgatgcaaaagtagggaaactgaaacttgctaaagccaactatctttcacagaaatatgaacttgaagacagaattttaaaatactatccacaaaaaatcaaactcattgaagaaagaattgattgtttagaagcggatattgaatcagctgttcctcaaaaagaatttgtagaaatgacgattaaggatatgaaaataactgataaaaaacaggcagggcaggcaattctattagcctgtcagcagctgaaatcttaggaggaaattacaataggaaactatcgaggatttgaaatgcagttaagatataattcttttcataatgagcatattttgactttgaaaaaacatttaagctatcctgttgaacttggaaatgatgtctatggaaatattacccgtattgataatgtagtagattccattcctaaaaaactggaaatagaaaaagcaatatatgatgaaaccagtcagcagtttatcaatgcaaaagaagaagtggaaaagccttttgaaaaagaagatgaactgcaaaatttaagtcaaagattatcaaaattgaataaagaactggatattggaggaaagaatgacaaggaatcattatcatttgattatgatactcctgaagaagataattgtccttcagtatcactggaaagatagagtgaaattttaatgacattgattataaattggtgtacaatataacaataaaggaggcatgaatatggataagattaatatcaatgattttcctagtttagatggtgtatcgcttattcctacaaaaactttgcaagttattatagatatatataatgacgaagttgaaaaagaaatgtacaaatttgaaaatgctgtgaagaaaaaagccaatcttataaaagaaggaaaagtaaaagcatattcagatggcgaattttttgaacttctagaaggagaagggctatagtgtgaaggttattattgatgagagtgtttttctatttttaaaagaaaacagaataaaactttcacaacagtttaaaacagttgtcagtcatttaaaacttaacccaagaatgtatgcaatgatcacagatgatgatagcattcgacattttgttatagaaggtattgattttggatatatgattgatggtgaaatggttattatttcagattgtagatttgtaaaatcaaatacaaaattaaaagtaagataggatcagtttataaactgattcttttttgtaaggtcgacaatactatttgtcggctttttatttttggaggagtgaaagatgaagaaatttttaaagccagaggaattggcagaggttaaaaagttagacttactgacatatttatctaactatgaacctaatgaacttgtcagaagatcacgcaatgattatgtgacaagaacacatgacaatctgcatatgactaatggcatgtggatgtggtggtcaagaggaatcggaggtaaaacagctcttgaatttgattaaagtttatgatatgccttttttagatgctgcacttctgatatatcaatgtattacaaaatggattgttaacacttttttggacaatttttatgagaacagtcgatattcaacgggtgttttataatctaatgatccatgtattctgatattattataccagttaacataatcaaataattctaattccaattctttaaaattattaaattttctattaaatgcaaattctgttttaactattttatacgttgcttctgctactgcattatcatacgggcatccctttgcacttaatgaacgtgttatttcaaaggtttctaatacttcttctatgattttatttttaaattcatttcctctatcgcttttataccgaattcagtataaaagcgataggggaatacattacacatcgaggaggtatcgtgagctgacaagggatatggtgtgcagctattcaagaaaaggtaatccatgggataatgcatgtatagaatcatatcatgcgttaataaaaagagagtggtttaatagatttaagataatgaattatcatcaggcatatcagctggtgtttgaatatttagaaggattctataatacagtaagaatccactcacattgtgaatatttatcaccgaacgaatatgagagcagacgcatgttagaggaaactaactaaatttcttacatttagttagtccgaaatcttgacatagaaccaattaagaaaatgatcacaattctttcaaataataatttgatttatgaaaaataatatggaaagatgatgctaataacagtgagtaaagattttaaaatagacaaatcattatattcacaaaaagatatagaaaatattaatagaacattttaattatttaaaagaattaaagacacaactcaggcagagttaattacaaccattttattttcattcgacattttgaaagaaacttatcatgaaatcacagaaaatatgatatatgaatatattacagaatggaaaaaagatatagcaattatcaaagtgaattaaagaacttattaaattgcttactggaataggtttgattgctactgattattccaagaattatgtcgatgatatattttgttaaaatatattgcaaatttataagggacaatttataaaaagttgtccttttttatgaagggcatggcatacatatatctaaggtgaaagtaagtgttttatcattagtttaactattatcaaaaaacaattaataattactgtttaagtgataagcaaataaaaatgatgcatgcctgtagattataggttttgcatcattttctaatcaaaactttaaaagtttgctgatagattatttatattgtttggttgttaatgtcgaaattgtatcataaacgtaactttcatttgttttatcgcacattattataataacatcactagcttttaaatatgtttctccatgaggaatgaattcttgaccatctcgacgtaatgacacaattagacaatgagtaggccaagtgacttctttaattaaacgattatctaaataagagtctggattgatcataaaatctaatagtactttttcaccaactcccttagggatagggaaattacgcttttttaataaattttctaataaactttcataaattggttttgatttcattaaatcagcaacaatatatgaaacaatagttactgttgtaattgaaagtaggtgatttaatgagccagtcatttcaaaaattaagataattcctgttaccggcgctctaactatagctgtaaaatatcctgccatagctaataagataaaattattgatataaactgcatctaaatttaaatatttcactgccccatgtccaaataatccaccaatcaaacaaccgatgacaagtaggggaaagaatattccacctggtgctccagaaccaaaacaggttatggcaaatataaacttgccagcaagaagacaaagaatcattaaagcagtcaatttaccttcggtaaggagatcaactagaacatccccgcttcctaagatttgtggtactataaatcctaaaattccagaaattataaaaggtatcaataattttttgaatgtatttaaattttcaaatcgattataaaggctttgaacatacaataaagctttattataaaaagccccagctaaacctaaaatcactcctaaaactaaaaccatccaataataattagttggaagcgctttagctactttaaaagaaaaaacaggatccattcctaatatattgctcattgtataatcggcagcaattgaagaagccataacagagattaataaaggagctgaaaaatgtttatgaacttcttctaaagcaaacattactccagctagtggagcatgaaaagcagcagctaaccccgcacttgcaccacatgtaagtaaatagcgttcttcggttttgccgcgttttagtatttttccaattccttttccaaccatggcaccaagctgtatcgaaggaccttcgcgtcctaatgccaaaccacaaaagttagttaaaaagccccctaaaaatttatttattaagacccgccaccatttagcatcgatcttaccagccaattcaccctctaattgtggtataccgctaccagaaatcaaaggttccgtatttagcagttttgaaacaatataggcaataattattaaaataacaaaccaaaggatgatcgtaaaaacagattgtttgcagtatatcaagatctgctctaaccaatttgctccattactaagacaaattcgatatcctacaattactaatccccctaatattcctactaacaccccttctaatagtagaattaatttaaattgttttacatttaaaatattaataatattttttctcatatccgcccctcacttcgattgatattataaactatggataaaaaaaatcatagttgttttcagataaaaataaattttgttttatttatcaacaaaatattgtacaattaaggaggtgatgacaatggataaacgatcggatgcaatagaaacagttgtagatgtttttaatgaagctatggcaattcaagaattatatcttagaaagagtaagtttaaagaattatcaatgagtgagacacacgtgattgatgcagttgataaagctgaatttccttcgatgactaatgttgcaaaaatattaaatgtcacaatgggaactctaacgacagcagtaaaaaagatcattgaaaaaggatttttgatcaaagaacggtctaaaaaagatcaacgtgttttttatttgaaattaacggaaaaagggcatgaggctcttaaaattcatgaacagtttcatcgtgaattagcagatttgtataaagctgctattcctgatgatcgtgttgattgggtttttgatacattgaaaaaaatcaaagtggatttagataactataaaaaagcattagaacaaaaagaataacaatccagggcgtctataacgccctggattagtttttagctaatgaatcaacaaattagaggtttatgtgtgaagtatttatttaaataattcatttagctggttacttgccataactagtaatgttattgatttaggctggtaagattcaataatttttgcacaagtcatgatagtattaccagaggtaattacgtcatcaaaaattacgacatcttgattgcataatctttcaccattttcgattttaataatcttatttacaagagaacgatcagtttgctgggtttgtttgtaagcggtagttttaaacaaacctgtaaaaatattattactaaaattttttacgagcatttcatttggactaaagcctctttttaaattatcctgtttactgctagggacaactacgatcatatgcttacggtatttatactttaactctggaaaagagttaaaaaaggcatcttttaaagcatgatccccttgtcccttatactgaaataaagtttttttaaagaagtcattatagtagtataaaatagttattggataattttgataaaaatggtgttgattataaataacaaacttgttaagacactttaaacataatgttggttgataaaaaagatgaaatagactaggctgtttatttaaatcttcaaaacagatcaagcattgtcttttttgagggttttgatgcattgtttaatagctttagtcttatagggggtaaaaatgctaattgaacctgtagggtaattaacatttcgtcctactcgtccacaaatttgaatcagggttgaagatccgtatatagggttattgccatacagtataattacctgggcattgctgattgttatgcctctttctaaaattgttgtcgtgataagggcatcaagttcacctgtttttagtttttttaaaaaataatgaatatttttacttttagaactaacgggatgattcttgataccaaataaattaaaatatttatggacagcagtagtcagctttatcgtaggaacaaaaattaggactggtttcttttcttttttgtataataaagcttttttgatagcgataaaatacatcagtaaaggacctgttatatagcattttggaatatctaaaggatgaccatgatagcgtttggtcattaataagttgggatcgtttgttaaagtagcggacatataaatgtaatttcctctaatgctgtttttaaggatgttatgtaaaacctcattattagcgtatggaaaagcatctaattcatctaagatcaacaagtcaaaataatgagggtatcgataaagctgatgggtcgtacaaatgataaaagaaccattagttactgctgtattgccaccataaacagaagttattgagatatttaaaaattgactttgaaatcgttttgtcaattcaataaccaattcttttctaggcgttgtaaaacagacattatgccccagatttaatgcatatttgattacttcataagttatttccgttttaccagccccacatacagctttaagattagtatttaaatggttttgataacggagtaataatttatttgataattcttgttggagagatgttaattggtaatttaattgaaaatcgactggtaaactaggctttgttttaatatcttgaacagtatcattagttaagccgatcttaatacatttacgacaataagttatgttattaaaagtataaaaatatcgtggatcttgattcttgcatcgtggacagatcatcttttatcacccatctatattgtaactcatattagctctatttttgtctcaaattggtgatatatttttcttattaaaatctcaactttgtttatttaaaaaacgctaaaaaaagtcttgataatcaagggatttacaaattattacaaaagctttgataaattttgacatgaattttaagaaggcaaaatttgtcgagtgaaaaaaatttatatttaaaaaaagatataatatactagcattgaccattgttaaaggggtgaattaaatgcaaggaaaagtaaaatggtttaacgcagaaaaaggttttggattcattgatcgtggtgaaggcaaagatgtttttgttcattatagtcaaattgaacaagatggatataagactttaaatgaaggtgaattagttgaatttgatctttatcaaagtgaacgtggaatgcaggctaaacatgttgttaaaatctaggaacagagaaatttctctgtttttttagttatgatcgattatttgatttgagagctgattttgaatgaaaatatgattgattgaattagtaactacaagcataaaaaggtcatatttaagcaatatttttagaatgattaaaaaaagtgaaaatgaaagtgaaactcaaataatttatgcttttaaatatagctataaaatgttataatactgtagactaaagctataaaagaggagcgtatttcatggcaagtagaaaagaagaaattagaaaagaaataaaaaagaaaaatgaaaaggaaggtcttaatcctgaagcagtaaataatattgttgatttacaagaccagactggtgaagatattatagttgaagattttaaaggtatttataatggtgatgttattccatttagtactacaccacattcaactaaaaagagcttggttggacgtattaaaggaatctttgatgatgaaaataaacaactaaaaaaattaagtaagatagctgatgaaatcatagcattagaatcaaaatatcaagctatgtcagatgaagaactagcaaataaaacaaatgaatttaaagaagctttagctaatggaaaaactttggatgatattattgttgatgcttttgctacagtaagagaagctgcatatcgtaaattaggattaaaagcatttaaggttcagttgatgggtggaattactttacatgaaggtgatatcgccgaaatgaaaactggtgaaggtaaaaccttaacatcaattttccctgtttatttaaatgctttaacaggtaatggggtgcatgttgttactgtaaatgattatctagctggtcgtgatgctgaaaataatgggcaagtttttaactttttaggacttacagttggtttaaataagcgtgagcttacacctgcccaaaaacaagaagcccatggctgtgatgttacttatacaactaatgctgaattaggatttgattatctaagagataatatggtgactaaactggaagataaagtattagttaaaggattaaattatgctttgatcgatgaggtcgattctattttaattgacgaatcaagaacaccgttgattatttctggaggacgtaaaaatacagcggctttatatatgcaggcagaccgttttgttaaatctttaaaagctgatgttgattatgaagtcgatattgaaagtaaaacagttgctttaacggctgacggtattgctaaagctgaaagaggatttaagattgcaaatttatatgatccacagcatacatcattagttcatcatattaatcaggctttaaaagccaattatacgatgactcgtgatgttgaatatatgattgcaacagaagatggtagtcgtgatattagaaatgctaaaattatgatcatcgatcaatttactggtcgtgttatgcctggacgtgcttattctgatggtttacatcaagcaattgaagctaaagaaggggtaccgatcaaagaagaaacagaaactcgagctactattacttatcaaaatttctttagattatttaataaattatcaggaatgacaggtactgctaaaactgaagaagaagaatttagattgatttataatatgcgagtaattgagattccaacaaatagacctgtaattcgtgatgaccgtaatgataagatctattcgacaagagttaataaatttaaagctttatgtgatgaagttgttgctcgtaattcttatggtcagccgatcttaattggtacggtatctgtagaaacatcagaagtattatctaaaatgttagatcgccgtaaaattagacataatgttttgaatgctaaaaatcatgctaaagaagctgaaatcattgaaagagctgggcaacgtggggcagttacgatcgcaaccaacatggctggacgtggtactgacattaagttaggcgaaggtgttgctgagattggtggtttagcagttattggttctgaacgtcatgaatctagacgtattgataatcagttaagaggtcgttctgggcgtcaaggagatcctggatattctgttttctatgtttcttttgaagatgatttaatggaacgttttgctggtgaaagattgaaatcatttacagaatatttagaagatgatcaagccattgaaaataaagttgttactaaagcaattgaaggagctcaaaagcgggttgaaggacaaaactttgattctcgtaaacatattttggaatatgatgatgtaatgcgtcaacaacgtgaaatcatgtataaagaacgtgatgatattatgtcagaagaaaaactggatgatattattaaaggaatgtttaaccaggccattgaaatgacagtaaaacagtttactaaaaacgatggtaaacatgatgtgatcgatgttgaaggtgttgtagaatttgttgctaaaaactatatgttattagtagaagtgcaggcaaataattgtgaagcattggtgcatgaaccacaaaaattaattgatactcttactgatttagtatttaatcaatataatagtcgttacaataaagaattagaacctgaaaaaagattacgttatgaaagaagtatccttttaggtgtaatcgattatacttggatcaatcatattgatgcaatgacaaaattacgtaatggtatttatctacgtgcttatgctcaaaaagatccattagctgaatatacagaagaagcattctatatgtttgaacaaatgactgctagcattgctgacactatttctcgtaatattgttcatatgggtgttcgtcctggtagcgaagtagaacaagctattccacatttaaaaatggaacttacttttaaataatggaattatatgaaattaaaaatgggctttctaaagcccatttattaatagatgaattttatcattcaattaatattgaaagctaccgtagagaaatagaaggacttacagttattaccgaacaagagggattctgggatgatgctaataaagctaagattacgtatgataagttaaatcaaatgaaaaaaattgttgatcaatatgacacattaaatgcaatgttaaaaaatcttgatgaaacttatgaattagtaaagagtactgaagatttagaatttaaagaaattcttgaaagtgattatttgttatttgaaaaagatttagacgaatttgaaaaaatgctgttattatctggagaacatgataatttaaatgcaattgtcgaaattcaccctggtgctggagggacagagagtcaagattgggcagaaatgttgtttagaatgtatcagcgttatgctcaaacaaaagattggaaggtcgaagtgcttgactatcttgatggtgacgtagccggaattaaatcggttacaatgttaataaaagggaataatgtttatggacacttaaaggctgaaaagggtgtgcatcgtttagtacgtttatctccttttgactctgccaaacgtcgccatacatcatttgcgtcagttgatgttattcctgaatttaataatgagattgaaattaatataagaaatgaagatttaaaaatagatacttaccgtgcaagcggtgctggaggacagcatataaataagacagattcagcagttagaattactcatcttcctacaaatacgatcgttacttgtcaaagtcagcgcagtcagctgcaaaatcgtgaacaggctatgatcatgcttaaaagcaaactttatcaattgatgttagaaaaacaagctagtgaattacaagagataaaaggagaacaaaaggagatagcctggggctcacaaatacgttcttatattttacatccttattctttagtgaaagataatcgcagtaattatgaatcaaataatcctaaggtagttttagatggtgatcttgatggatttatttatgcctatttaaagagtactataggaggataagatgaaaaaaagtatttatgagacaataataattattattggtaattttattttagcgttaggaatttgtgcctttatcactccggctggtttgattaccggtggtgcttcaggaataggaattgcgataaaatcattgaccggtattaatatttcctatactgtttatgtaataaatatcataatgtttattattggttatatatatttaggtaaaaaatttgcattaggaactttattaagtactattttatacccaacttttttagtgatattagaaaaagtttctgaattagctagtattactaatgatgctttactttcaactttatatgctggtctttgtattggtcttggcttaggattagttttaagagttggtgccagcactggtggaatggatattccgccactgatcgttaataaaaaaacgggagtttcgatagcctggttgataaatatttttgattgtgttattttgttacttcaagttattttttgtcctatctcaattgagcaggttttatatggaattacagttgttattattacaacgatcgtaatggataaagtaatcatgcttggtgaaacaaaggttcaagtaacagtgatttctccaaaatggcaagagattcgtaaagttgtatttgatgatataaatcggggctgtacattattaaagatcacgacaggatattatcaaaaaaatcaatatgcagtcatgtctgtcgtttctaaacgagaattgcatcttttaaataagatggttttagatattgatccaactgcttttattattagtaatgaaacacatagtgttaaaggacgtggttttactttaccaccagttgaattgtaatttttatttggtatgaaaataaaggatattgttttaagtcactttttagtctaataggaatttcgattcgtttaggtataaaataaaaatatccaatcataagggtacatttattggctggatatttttatgtggctaaaaaagtgttagaaatatcattttttcctaaccattcttccattgcattttggacactgacagctgtatccttgattctctttacctgaatatatttcttcacctaaaaactcttctagtatccattccggtacttcttcttcataaccacatctcttacatttcatcggtatcattacctctggttcccctaataattctgctagttcttcatcggtcagattgatcacttgtttaccttcttcctatgctcatagctgtattttgctttgagaatctttcggtcacgatattctctgtcatttttatcgtttccaccaaatggttcatagctttctttatattccattgtttctccacattcacaaagcaatggatcccgttgaaatgattttatcatattatatctgaaatgtaactctttttgtctcttttctatcatcacccttctgtcattttttagttcttctactcttttttgtttatggctcaacagttcagccatcctgttataggtctttattgatttatttgaataaaaaccaaaatatcttaccatcttgaagttcttttcaggacagtgcatcaataccttgttaagaaaactgtaaacagattctgtgacatctacacgcttattatcttcatgacgatgatagaaccaatgaatcattttcttatcatcatcatagtttactatcctgctttcagccattattggtctgctggtataacgggttatatattgaacacatttttcaatgtcgtccttagtctgttcatctttgatttttggagcatagacatagaacccttcctcgtattttcggtagaaccagcttttaaggctttgaaattctttgtcgttgccaatgtgtctgtcaagatagctgagtaattgataacgccatgtctggcgaagttttttatagtccatataactgaagtttttgattttgtcatctttagaatcataagcatcttcgcataccagaacatggatatgcggattccagtcaagaggtctgccaaaagtgtgcaatgaggcaatggcaccaaagatcacattatcagttgtatctttgtaaagatattgagatttattgctttttttatgatagaagatacctttctttttttcaagacgcttttgtctgcgatattttctgtcgttgaaaagggaagccagagtatttctggcaacgacaaaaagaccatcaagcagtgatcggtttttgataaagtagaagcgaagctgagcagggatggtaaagacgatatgacgatgtttggatttaaaagccatagagctgacataagcagcgcgtctttgactggatttagaaccacatttggtacagtatctggaactgcaggtatgagcaacaatagtttcattgccgcagttaggacagacaaagagatcataaccaagatggatagaagaacaaaggatagttttttgaacattatcaaaagaaacatccctgagtttgcctttatcatgtagattaatgatatagtcgtaattgtcaaagaagatatatttaaaagtatttttaccgtcttttttaacaaactgcttaaaattaaaaagacctaatgtatcagaaggaacagataaatcgatcataaagtcatctcctaaaatcattataataccaaaaaggatgaaaggcatttaaaatgcactatcacccaggtggacaaaatttattttgtcccttttttataaaaattttatcaattaaatagtctttcatgtatatgataataaaaaattgggatcagagtagatcccattttatctgataatcattatgattttatgttatcttagattatcatttttacataaaaatttttagtcataatatttatttgcaaacttctatacttctgctagttaaaaattatttatttaaatcaatataaaattccacatgtccacaattagagcagtaacgacatttaagctcataattttttttctttaaattatcattttttataattaattctaaatagcttaaagctgcggtaccattatcttttacatagcagtttgtatttaattcagtttgacaaataggacacttttttttcatactgtcacctctttaatttctattgtaccataaaattatcgagataataatactaattgtccccttattcgtcaaaatgtgctataatgagtctcgaagtataagatacttcaaaacagatcatagaaagaaaggagacagtcgaaaaaaacggcaaaatatatgataaaacttactaatgtaacaaaaatatataagactggtgtaagagcattaaataatatgaatcttacgattgaaccaggtgaatttgtgtatgttatcggaactactggtgctggaaaatcaacttttattaaattgttgtatcgtgaagaaaaagcaacatctggtaaagtagaagttgtagggcgtgatgtttcaaagataaagaatcgcaaggtaccgtattttcgtcgtaatattggagttgtattccaaaattttagattattgcctaaaaagacagtttttgaaaacgttgccttcgctttagaggtgattgacacacctcgagttgaaattcgtcgtcgtgttagagctactttagagttagttgggcttgaagataaggtcaatgcttttcctcatgaattatcaggaggacagcagcaacgggtagcaattgctagagcgatcgttaataaaccgaaagtattgattgcagatgaaccgactggtaatcttgatccggaaacttcaaaagagattattaatttattagaaagaatcaatgaacagcagcacactacggttttagtagttactcatgatagtaaaatcgttcaggaacacaaaaaaagaactattttaattgaagatgggtgtgtcaatgctgatactagtttaggaggttatgaaatctaatgaatgaattaattagttgtattagaaacctccctaagcattttaaaacagctttgcaaaatatttggcgaaatggtgtaatgtcattttcatcaatatttgcagttacaattactttagtattaattggggtaattggagtactggctttaaatattcaagatatgagtttgaatattgaagagggagtaagaatttatgttaaattagaccgtgatattgatagtactgctgaacaggcggtaggtgaggaaataaaggctattaaagatgttaaatcagtcactttttttactaaagatcaagaattagataaattgattgaaaaacaaggtgaagatggagcacagttatttgaatcatttagagaagataacccgcttggttcagcttatgaagttgaagctaaagatgcttcaaaattagctagtatttctaaaaaaattagagatatttctggagtcagcacagttaattatggtggtgaatcgacacaggatatggtaaaaacattacaaacgattcaaacagggggaacgatttttattgttgccttagcgatagtagcattatttatgattgctaatacgatcaaaattacgattacagctcgtcaaacagaaatcagtatcatgcgaatggttggggctagtaactggtatattcgaattccatttatgttagaaggaatgctgattggtttgtttggatcgattattccgatcatcgttttagtgtatggttatggaatgatttatgattatactggtggaatgtttatgtcagcgatgttagcgttgaaagcgccaatgccgtttatccgtgatttctcattagttttagcacttttaggcgctggagttggattggttggaagttttgtttcaatcagacgattcttaaaattttagcaggtattgacctgcttttttgaaaagaaagttaaatgaaaagagaaattctagaatttttaaatcaagattatcttaataatcttgatttaatttatgctattgatcacggtgctaagatcatttattttggtaatgaagggataatgttaaaatttggtgatatgtatatgctatcacttaaggattctgatttaggatgtcaattattgaatgaccttgataattgtaatatgctggctgttcataatgatcattaccacgatcttatcaaagaaaaatttgatcttgatcaaaaaattgtggcatatcagtatgggtatttaaaaaatgatgttgaaattgttaaagttccacaaatagaaataagaaaaattgggatggagtattatgattttattaggcaaaattattcaactttagttgatgaaaaatatttacaaagccgcattcagacaaatgtttttatcggtgcttttgatcaggataaaattgttggatttgctggaattcatgacgagggatcgattggttttgttgaagtgatagcgaaatatcgccgtaagggaattgcaagaatgttagagacatatatgatcaataaagcgttaaagaaaaatgaactaatctatttgcaagttgagcttgaaaatacagtttcgatgagatttcatgaaaagttaggatttaaacgagctgatgatataattacctggtatatgtaaaggagaaaactatggaaaagtatgaatttaatgatttaaaatatttacagatccctttgcctgaggagttattaaaattaaagtggcatggcagttttaaacggatgaataaagttattgaagcaaaacttgctaaagatattcctttagcattgaaaaaaagactgcttcatgaaaaagagataattaaaagaatgcctaaggaatatcctttggcttatcaagatgctttaaaaatatgtcatgataattttattaattttaaagatgccgagttagaacagctacaggatgaaaatgcggtagagtggatctttgttgaagggaaggcacagtttagagatgatttttttgataatataattaaaacgcgtaatgattatgtaaaaagattaaaagatcctagtaagataaaaagtcgtgaaactaattttgcgttattaaataatgcaataaaggaaataaaagagaaaggtaaattagcttatcattttcatttgaagaccggaatgaagatcaagactaaggatactgataaaatgattagagttcatttacctataccattagaaaattgtcaaataagtaattttaaattattaaaaacgacaccccaaaatcgctccttaaatgaaaaagatcatcctcaaagaacggtttattttgaagaaaacattgatgatattaaagaattttatgttgaatatgaatatgataatatgattgaatatcaggagcttgattatcaaaaagttttaaatgatcaaccaaaattttatttacatgagcaagctccacatattgtttttacaccatatttaaaatcattagcaaaagagatcattaaaaatgaaaccaataatttaattaaagctaaattgatttatgaatatattactacccatattacatattcatttgttcgcaactattatacaattcctaatattcccgaatatgctgctttaggcggtaaaggtgattgtggcgttcagactctattatttatcactttatgccgctatgttggtgttccggcgatgtggcaggcaggtctttatgtaactccatacgatattggtaatcatgattgggctcgattctatgtggctccatatggctggctgtatgctgattgttcgtttggtggagcggcttatcgtaacggtgataaagaaagatggcagtattattttggtcatttagatccatttagaatggttgccaatagtgaatatcaatatgatttatatcctgccaaaaattttattcgtcaggatccttatgataatcaaaccggtgaagctgaatatgaagatcgagggttatatttaaatgattatgatttgcatttagaagtaatggatattaaaaaattataattaataagggaagcgctgggcttccctttgaaatatttaattttgacttttctcttgtttttctaataattctaaccagcgttcatttttggcttctaattgttctgttaaatgatcacgttgattagatagctcagttagttttttaaaatcattttgatactcattcatttgttcgttaaatatttcaatttgttcttctaagtctaaaataatactttccattgattctagttcctgtttttctttagaagataaacgtacttgattttgtttttgtaatcttttttgctctttatacttaagggcaccatcccccttagctttagatgatttatcatcaatattaacataactgctataaccgccattacaataagttatttgtttgtttttaaaaataaataaagcatcacaaatacgatccaaaaaataacgatcatgagaaaccgtgattacaataccattaaaactatctaaataatcttctaagattgctaacgttgtaatatctaaatcattagttggttcatcaaataataaaacattaggtgcctgcattaatatatttaataaatacaaacgtcttttttcaccaccagataatctagaaatatacgtatgttgtaaacttgagtcaaataaaaaacgttcacacatttgtttagcgctgaaagttccttctaaagtttttaaatcattactcgtttgtttaatataatcaataactcgcatattttcatcaaggtcatcgctcatttgtttaaaataaccgattttgatcgtatcaccataaataacttcaccattacttggatttaattcttttgcgataatctttagtaaagtacttttaccacaaccattaactcctaaaattccaattctgtcagttcgtttaaataaataagaaaaattattaaataaagttaaattatcataatgcatactaatatttttaagctcgatcgtttttttaccaagtcttgaagcagtattgatcatttcaacttgatttatcgtttggatatctgcaatactatttaattgctcaaagcgttgtaatctttctttacttttagttgttctagcctgaactccagctcgcacccattcaagttctttctttaaaaacaattttcttttccgttcactagctaaggcttcttcttcacgttttgcttttaaatctaagaatttagaatagttagcttcatattcatatatcttgctacgatcaatttccatgattttatttgtaactctttctaaaaaataacgatcatgagtaaccataaaaatagctttgttaaacttgatcaaatatttttctaaatactcgatcatttcattatctaaatggttagttggttcatcaagaattaataagtcacagggttttaataaagtaattgctagagcaacacgtttttgttgtccacctgataattctttaattaattgatcatgattagtgatacctaatttatttaaaattgctttaacttcatattcattgactttattttggtcgatcatctcatagacttgtttaatgatggtattatgggaattaaaatcaggattttgtggtagataagatatttgtagatcttttttttgaataatgtcaccttgataagtttcaatgccggcaatgatctttaataaagtacttttaccagtaccattaataccaatcaaagcaattttatcagtttcttctattgaaaatgagacacgatcaacaatatttttaattccatttgttttagataaattatttacacttattaacatacgattctccttaaattaactatattctatcatgtaatcaatatttgtaaatgagtaattaaaagtgattttatatgttgataactaaaacggttattattttgactagataatatggctagctaacatcttgtaagatataagcagttattgctgtatagagtatattaatatacaagatataggttcaaataaaaaatttattattgattaaaatgaaaaaagtgtaaaaaaagattaaagatgaaaatctttaaccttttttagttactattacttttttgaaataatatgatctatttttatgatgatatagataaacaaatattataatcttgattactgaaaaactttattcttgatataatctttttggtgatataaatgaaacgttatacaattggtaaaatggcaaaattaaataatgtaagtgaacaaacattaaggttatatgataagatcgggttatttaaacctgcttatgttgacgaaaaaaatggttatcggctttatgatattggacaatcagcaagactcgatattatacaatatttaaaaaatttaggaatgactctaaaagaaataaaagaggtttttgattatagggatttatcgttattgcaagagaaactagaagaaagcaaaggacaaattgatctacaaattaaacatttaagggaacaaaaagaagcaattcaaagaacgatcgattcatttgagctgtttaaagcagcccctaaagccggtatgataactttagaatttattaataaacgaacgatgctttacgtagataaaaaaattaatatctatgactatgatttagatgtttatgaaagtttgttaagagagtttaaagatgatttaattaaacaaaatttaccaccaactattttctttaatccgggaacgattttaagaaaagaacatgttgaaaaaagagaatttatttcaagtgagatttttgtttttattaatgataaaaataaagtagttttaaaaaaagaaacaattcctgcaagtatgtatttatgtatatattgtgatgatttcactaatgagaaagaatatgcttgtaaattatttgatgaaatagaagctaaaaattatacaataatcggggattatttatgcgaaagcttaaatgatatcttgatatttaacgataaaaaacgaaatatgtatttaagactgcaggttcccgttaaaatttaaaaatagaattacaaatacttgactttatggtaaccataaagtttatactaaaagtatcggaggtaattaatatgaacaaagaaaaagttagagtagttcagtatggatgcggaaaaatggcaaaatatattattcgttatctatacgaaaaaggtgctgaaatcgtaggtgcaatcgatgttaatcctgaagttgtcggtaaagatgttggtgagtttgcccagcttggatttaatcttggtgtcactatcagtgatgatgctgataaggttttggatgagtgtgatccagatattgcagtagttacattatttagttttgttgaagattgttatccacattttgaaaaatgtgtaagtcggggaattaacgttattactacatgtgaagaagcaatttatccatggacgaccgctagtaaacttactaataaattggatgaacttgctaaagaaaatggatgtactatcgttggttcgggaatgcaggatatgtattggatcaatatgatcggtgcagtagctggtggtgttcataagattaaaaaaattgaaggagctgtttcttataatgttgaagattatggtttagctcttgcaaaagctcatggggctggttttacaccagaacagtttgaaaaagaattagctcatcctgaaactttggagccttcttatgtatggaattcaaatgaagcattatgtaataaaatgggctggacaataaaatcacagacccaaaaatgtgtgccttatttttatgatcgtgatttgtattcagaaactttacaggaaactattcctcaaggcaattgtattggaatgtcagcagtagtaacaacagaaaccttccaaggaccaataatagaaacacaatgtattggaaaagtgtatggacctgatgatggtgatatgtgtgattggaaaatcattggcgaaccagatgtcactttttatgttgaaaaaccagctactgtagaacatacatgtgcaacgatcgttaatcgtattccttcagttttattagctccagcgggatatataacagttgaaaaattagatgaattagaatatttgtcatatccaatgcatttgtattgtgatgaataatagtttttaaaaattagactcaaaaaactaacagataatatatttactgttagttttttagtaaaatgcttttaagagaatgtaaagcgattaccgcaaagaattttgaataaataaaaaacggctatcaagccgtttgtttatatcctggcagaggtagtaggagtcgaacccacatcaacggttttggagaccggtattctaccattgaactatacctctatttccaactgctctactataataacatatctttttaaacttgtaaataaaaaaattaaatgttttaaaaaataggtatttgtctaattgaagaatattataaaaatcttaagaaaatcataagatttttattattgaatgagtataaaacatggtttataataagcaacgtatgttttataactaagggagtgtaatcatggatgaaaaactatctatagtgataaataaattgggacattgtttaggaactattttgttgatgagtgtaattatgacaattacgatctattttgaaatcggtggtgtctattttagttcttataatttggataataaatataatatgcttattgttcccatagtgattatcttagtttttgttttaatgtattttttgtataaaaagataaaacagatcgatttagagaataaaaagagatattatttgattttatctattattgcgattgtaattgtaggactacaattatatagtatttatgctattaaggttgaaccgagctgggattttggtgtagttcaccgtgaagctattcgtttagcgacgagtaaaagtcaaattactaatatatcttattttagtacttatacaaataataatttaatgttattaatgttgacagggatatataagattttaggctgctttcatattagtgattatgtaacggcgagctgttttgttaatatgttgatgatcgatatcccactagtaattaattattttagtgtaaaaagattattcagtcgtaatatggttgttatgtatatgattttaacgatgttttgtttaccgatctatacttacgtgccgatcttttatactgacacatatccaatgatttggggctcattaattgttttattatatataaaaatgaatcaaacgatgaatctcaaagaaaaatatttggaagcagttttgattgggatttgtgcattgattggttttgaattaaaagcaacgatcttgattttgctggctgctgttattctgcactatctatttacaaataaaggaataaaaaaacttgttattattgcattagtagtagtttcatttattacctcgatgacagcatataataagatgatcgatagtactaatctttttaatgatttagattatgaagcagaggctttgccgtatgttcattggataatgatggcattaaataaaaccggaggatttaatcgtaaagactataattattctaagtcgatcattggaaaagaggctaagcaggaagcggcaatcaaaatgattggtgaaagattaaataattatggatttagtggtttaattgggcatttaggaactaaaataaattacacttataatgatggaacatattactcagtttctttactggctcgtaaaccgctaaatacagattcattaggctataatttattagcaaaagatggaaaatacataaataaaacgatatatttggcgaatagttataacatttttattttagtaatgcttgtgttatcaatggttagtggttttagaaaagaaaaattagatttattaagttttcttagaattttattatttggcttaatgttatttttactgatttgggaatctaaaccaaagtatttggtaaattttttaccagtgtttaatattttggttttagatggaatgatattttatgaaaaaataataaagagggggaaattattatggatacattagcaatcgtggtaccttgttataatgaacaagaagttcttgcaacaacgatcaaacaattagaacagttaattatatcattgattgaaaaaggaaaaatagctaaagaaagttatgttatttatgtaaatgatggtagtaaagataatacctggcagattattgaagataattttaagctttttaaacatttacaaggtttaaatttggcaggtaatgttgggcatcaaaatgcgttacttgcaggattgcatcatgtaagtgataaatgtgatatggcaatatcaatagatgctgatcttcaagatgatattaatgtgattgaacaaatgatcgataaatattatcaaggctgtaatatagtttatggtgttagagatgatcgtagtagtgatactgcatttaaacgagttacagcgcagtctttctatcgagtaatgcactttttaggagtgaagtctgtttataatcatgctgattttcgtttactagataaacgagctttacagtttttgaaagaatatccagaaagaaatttatttttaagaggaatagttacattacttggtttaaatactgactgtgtatattattcgcgtaaagaaagaatggcaggagaatctaagtatccgttaaaaaagatgctttcatttgcttttgatggaattacttcttttagtataaaaccaattacaatgattttattattaggacttataattatgttttgttccattttagcgatcatctatacattattttcatacataaatggtcatagtgtagcaggctgggcctcattgatgatttcgatttggtttttaagcggcgtacagttgtttggaattggcttgattggtgaatatgttggtaaagtatatctcgaagttaaaagacggccacgttatcatgttgcaaactggttaggtgaaacaaatgatcaataaatattatcacaaatatcgggaagtgatcttatatttagtttttggtgctggaacgacatttgtcaatataatcgtatattatatatgcggacatggatttaagctggctgtttctataagtacgataattgcttgggctttatcagtactttttgcatatgtcactaataagatatgggtatttaattctaatagaaataaactaaaagagattttgattgaatttactcgttttgtaggctgtcgtttaacgacaggattaattgatttaataattatggtagtattttgtacctggttaggtttcaatgatttgataattaaaattgcttctaatgttttagtgatcatcatgaattatatttttagtaagttaattatttttaagggatgataataacccaggctaaatctgattttattcatatggtagagtagaaggaggaataaaatgaataaattggaattagcgatttcatcgatcaaatatcaaaagtttagaaaaatatatccgattatgaaagcttttcatacgggaacgatctttgaagaattggacttaccatggggtgagcttcaataatgaataacgatgatttattaatgcaaatcatgatgctggattttgctgttcaagaagcttcattatttttagatactcatccttgtgatgaagaagcaatgagatattttaatgaagctgcaacacgtttgaaaaacgctaaaaaagaatatcgtaaacagggaaatgttttaactaatcgtgaactagatgcttaccaaaacggttatttaaaggctccttggccatgggaaggtgacagaaaatgtggttgtatgaaaaacgcttgcaatatccagtaaatattacaaagcctgatgctaaagcagctgcagtgatcatcgatcaattgggtggtcctgatggtgaattagctgcagcacttagatatatctcacagcgttatacgatgccttatccagaaatacaagcattgttgacggatattgggacggaagaactagctcatgttgagatcatcagtgctattttatatcaattaactacagatttaacaattgatgaaatcaaggctcaaggatttgataaatattttgttgatcatacgttaggaatttatcctcaaggtgccagcagtgtaccatttacagctgcatacttccagtctaaaggtgatccgattacagatttaactgaagacatggcagctgaacaaaaggcaagaacaacttatgataacattttggcgcttgttgataatgaagaagttagaaaaccaattcgttttttaagagaacgggaaatcgttcactatcaaagatttgctgaagctttagaattagtgaaaaaacgtttagattcacaaaattattataaatataatccagcatttacaaatggtaaaaaaagatgtaactagatataaagttagatgttatattttaaaaatatgacatcttttacatatattaaattttattgatcaggtttagtgcacttatttgcttaaaattaagtgaaataataaattatattgatttaatcatgactttatgacataataatatgactttaataaaaaggagttatgataatgatatctacacaaaatgtatctttaagatatggcgatagagctttatttgaaaatgttagtgttaaatttacagaaggaaactgttatggaatcattggggctaatggtgctggtaaaagtacttttttaaaaatattagcaggtgaaattgaacccaataaaggtgaggttattttagaaccacataaacgtttatccgttttaaaacaagatcactttgcatatgatgaaaaaggtgtcgtagaaactgtaattatgggtaataagcatctttatgaaatcatgcaagaaaaagaaaaattatatgcaaaacctgattttaatgatgaagatggaattagattaggtgagcttgaaggtgaattcgcagaaatggatggttggaatgcggaagtcgatgcagaaattctattaaatggtttaggaatcacaaatgaattacatgaattgaaaatgaaagaattagatggtaatcaaaaagttaaagtattacttgctcaagctttgtttggtaatccagacgttcttttattagacgaaccgactaaccatttagatttagatagtattcgctggttagaaaactttttgatgaattttaaaaatactgttatcgttgttagccatgaccgttattttttaaataaagtttgtactcatatcgctgacattgattattcaagaatccaattatatgttggtaactatgatttttggtatgaatatagccaattgcaattacagcaggctaaagatcaaaataaaaaagctgaagctaagaaaaaagaattagaagaatttattgctcgtttcagtgctaatgcttctaaagctaagcaggcgacatcgagaaaaaaattattagataatttagaaatggtggatataaaaccatcacttcgccgttatccttttattgcctttaaaccgggacgtgaagttggaaatattgttttaaaagtagaaggtttatctaaaacagttgatggtgtgaaattgttgaacaatgttagtttttcaattaatcctaaagacaaagtggcatttgttggtgatgtaaaagcaacagaagtattttttaaaatcattatgggagaaattgaacctgacgaaggaacattccaatggggtgtaacgacttcacaatcatattttcctaaagataattcaaagttttttaatgactgtgatctatctttggtagactggctccggcaattttcagttaaagatgaatatgaacaagatttacggggctggctgggaagaatgttattctctggtgaagaagcactaaaaaaagcttctgtcttatctggaggtgaaaaggttagatgtatgctggctaaaatgatgatggctgaagctaatgttttagttcttgatgaaccaacaaaccatcttgatttggaatcgattcaggctttaaatcaaggattgatcaattttaaagaaaatattttatttactagtcatgatcatcaatttgtacagacaattgctaatcgaatcattgaatttaatgaaaatggtattttagaccgtttatcaacttatgatgaatatctagaatataaagaaaaaaacaagtagatcattgtactacttgttttttcttgtataatatttacaaggaggagcagtatgaatagtacagttaaagaattatttgaacgaaaatcggttagggtttataaagacaaagaaattgaaccagaaaaaaaacaattaatattagagtcagctattcaggcaccaacagccggaaatatgactttatattcaattattgatattcaagatcaagaaattaaagataaactggctaaatcttgtgataatcagccatttattgcaaaagcaccattagtattgatttttgttgccgattatcaaaaatggtatgatgcttttaaatattatcatgataatgaaaaagtcagagaaccatcttatggcgattttttattggcttatagtgatgcgctgattgcagcacaaaatgctgttgttgctggcgaaagtatgggaattggcagctgttttattggtgacatcatcgaacagtatgaatatcatcgggagttattaaatttaccacaatattgtgcacctgttgccatgctggtgatgggatatcctactgatcaacaaaaaagaagaccaaaaccagtacgctttgattctaaatatattgtaagtactgataaatatgaaagattttcatcagaaaaattagttgcaatgtttgatgatcgcgcaattaaagctaataaaacaagcggtggcaagggatatgttgatgatatttataaccgtaaatggacgaatccgtttattgaggagatgacccgctcatctaaactatggtttgaacaatggggaaaagaggatgaagaatcttaggattctttttctttatttaagggttgacatttaatttattatgaatataatatatagcacgctatctatttaaggaggtatacaatgcctaataaaaagactggatttttaattaaacaagttcatattcttcaagagcagcgtctaaatagaaaatttgaacattttggtttaacggctgcacaaacttttacactagttagtttgtttaaagctcgagaaaaaaatgagaaattaaatcaaaaagatcttgaaagaatattggatatttcaaatcctacagtaactggaatcttaaatcgtttagaagcaaaagatttaattaggcgagttacttgtaaacatgatgcaagaatcagatatattgaagttactaaaaaagctattgaattagctaaagaaattcgaaaaacttttaaagaagcggaagaacagttagttagttctttgactccagaagaaatagatagattaaacgaatatctaatcagaatattaagaagtgcttcttaatatttattttaaactaattcatagcacgctatatatttaggaggtatgtaaatgttaaaaacacttatagctcagattaaagagtacaaaacagctactattttaacaccattattagttattatagaggttgttttagaagttataattccgtttttaatggcaatgatcatcgatcagggaatatctgtaaaagatatggatatggtcgttaaattaggaattattacgttattagcatcttttgtttctttagcagcaggaggcctagcaggaaagtatgcagctaaagcttcaacaggatttgctaaaaatttaagaaaggcaatgtattacaatattcaaaatttctcttttgcaaatattgataaatactcaacagctggtttagttactcgtatgatgaccgacgtaacaaacgttcaaaatgcttttcaaatgatcattagagcatgtatcagagcaccattaatgatgatttctgcgatggttatggcttttacgatcaatgctgaaattgcctttgtatttgtgatcgcaattatctttttaggaattgtcttgacattttttatgacacgggctcatccttattttaaaagggtatttaatacttatgatgatttaaatgcttcagttcaggaaaatgtcaatggaattagagttgttaaggcatatgttcgtggtgattacgaagatgaaaaatttaaaaagacatcatctttaatatataaactatttgtaaaagctgaaaattatttagttttcaatcaaccattaatgcaattgacagtatatgcatgtattattggaatttcctggtttggggcacatttaattgttggtggcagcttaactaccggtgagcttactagtttatttacttatgtgatgatgattttaatgagtttgatgatgttttctatggtttttgtcatggtagttatgtcagttgcttcagcacagcgtatttgtgaagtaataaatgaagaatcaactttgcataatccagaaaatcctgattatgaaatcaaagatggatcaattgattttaataatgtaagtttttcatactatgatgatcaagaagaaatcagtttaagtaatgtagatgtgcatattaaatctggacagaccattggtattattggcggaactggtagtgctaagtcaacttttgtccaattgattccaagattgtatgatacgacttgtggcgaagtacttgtaggtggtaaaaatgttcgtgattacgatttagagacattacgaaatgaagttgccatggtattacaaaagaacgtcttattttctggaacgatcaaagaaaatcttcgctggggtaataaaaatgctactgatgaagaaatcatggaagcttgtaagttagctcaggctgatgaatttattcaacgtttcccagataaatatgacacatatattgaacaaggtgggacaaatgtatcaggaggacagaaacaaagattgtgtattgccagagctttacttaaaaaaccaaaaatcttgattcttgatgattctactagtgctgttgatactaaaactgatgctttgattcgtaaagcttttaaagaagttattcctggaactactaagttgatcatcgcacaacgaattagttcggttgaagatgctgatttaattattgttttagatgatggaaaaattagtgctatgggtactaatgatgaattattaaaaacaagtgatatttatcgtgaaatttttgaaacccaaaagaagggaggaactttaagtgaataataatcgtggaaaaacaatgaaaagattatttaattttgttatctctagacaccgtaatacttgtatagtgattcttttattaattattattagcagtttatctagtgttatgggatcgatctttattaagagtttaattgatgattatattactccttatcttaatacagttaatccggattttaatccgttattgaatgccattttaaaaatggtagctatatatgcaattggtgttattgcaacttatacttttaataaattgttgatcaatgtatctcaaggctcattaaaagaaatcagggatacaatgtttgaacatatggaacaattaccgattcgttattttgatacccacaaccatggtgatattatgtctatttatactaacgatacggatactttaagacaaatgatttctcaaagtattcctcaagtaattgtttcagcaacaacgatcatctgtgtttttgtttcgatgctggttatgagtattccgcttacgatcatcagtgttattatggtatgtgtaatgcttggagtttctaagtatgtaacaaatcgaagtggtaaatatttctttgctcaacaaactaatttgggtagagtcaatggttttgttgaagaaatgatggaaggccaaaaggttgttaaagtctttactcatgaagaagaagcaaagattgattttgataaagttaatgaagaattatttgaaagtgcttatgaagctaataaatacgctaatattttaatgcctttgattggaaacttagggtatgtaagttatgttttagtagcggttgttggtggtgttttagcaatcaatggttatatggatctaaccgtaggaactcttgcttctttcttacaactaaaccgttcgttcaatcagccaattagtcagatctcgcaacaaatcaacatggttttaatggcgttagctggtgctgaaagaatctttgctttgatggatgaagagattgaagttgatgagggtcatgttactttagtagatgctaaagaaaatgaagatggaactttatcaccagtaaattaccgcaccggtatctgggcttgggaacataaacgtcctgatggttcaattgaatatgttcgtttagccggagatgttcgttttcatgatgtaacctttggttataatgataataagacaattttatatgatatgaacttatttgctaaacctggtgaaaagcttgctttcgttggggctacaggagctggtaagacaacgattactaatttgatcaatcgtttctatgatatccaaaaaggatcgattacttatgatggtattgatatcaaattaattaaaaaagctgatttaagaagatctttaggaatcgtattacaagatacgcatttatttaccggaacgatcatggataacattcgttatggaaaactagatgcaacagatgaagaatgtattgccgcagctaaacttgctaatgcccatgaatttatcatgcatttagagcatgggtatcaaacagttcttagcggtgatggttcaagtttatctcagggtcagtgtcagttactagcgatcgctagagcagcagttgctaatccaccagtattgattttggatgaagcaacatcaagtattgatacgcgtactgaaagtatcgttcaaagtggaatggataaattgatggaaggacgtaccgtatttgtaattgcgcaccgtttatcaacgatcaaaaattctgatgcaatcatggttcttgatcaaggaagaatcattgaacgtggtgatcatgataaattaataaaagaaaaaggaacttattaccagttatacacaggtggtttagaattagattaagatatggataggtattagcctatccattattgttaaaggaataaattaatggtacagtataagtgaatgaaaggatatgatgtgatggaattaacatttagatatgctaatagtaatgatacagcattgatcttatattttattaaggaattagcaaaatatgaacagatgcttgatgaagttattgctactgaagaattattgaatgagtggttatttgtaaaaaagaaagccgaagtaatttttgctttaaaagatggaaaagagattggctttgctttgttcttccataatttttcgacttttttaggacgctcagggatatatttggaagatttatatatcaaacctgaacatcgtggcaaaggttatggtaaagctttgtttaaacagctggctaaaatagcggttgagcgaaaatgtggtcgcttagaatggtggtgtttagattggaatcagccaagtattgatttctatttatcattaggtgctaaagcgatgaaagattggacagtatatcgaattaccggagaaacgttaaaagaattaggaaaataaaaaaactactggatgtagtttttttatgcatgtttgacacgatctttttcttcagctgctttagcatcgttgaaacgatcaagtgttccaactaaatatcctgtgattcttctaattctttcaaagttttgaggctggaaaacataatctagatccacctcatcaccatcaattgaaattgaaagagactttaatgtttcattaggaaacttattttccaaatattttatatatgcttgaatttcctcttcatccatataaccattttttacttttacttgaacattgttaaaatcttccataatatcacctgttatgaagtgacctttgtcaagacaaaaatatacaattcataatatttttattaaattgtttcatcaaaggcatacaaagacttcaaacttatagatcctgcgacagttaaccactctgttattcgtggattggttaccaataggttaatggttcgtcgacaactctataatctcaaaacgtgggtcaatgttttcatcatttcaataaactcgcgactttttatcaaaataacattgccataaaggtgatttcttagatagttgaacctgttatctttttttgaagtccttctatgccttcgatgtttttatcttgttttattccttcacaacttcccctttctttatattttttctattcataatcatcttttatgcgatatgacctgtttctactccccatacaaagcatgccaattctctggctattgctgttactgctatatttttattgactcctcttaatatcatttgatgatatttcttctgtaatcttaatactgccttatctgtataatcaatgacctttacatcctgccctaactgttttgatttcactttctttccttttttgcctattgttcctcttaccagtacctgtgcacattcaaccaatgttgttcttacaagtgaatttccttgctttgttatacttaaacgtttatttttctctccgcttgaatcctctccaggtgttagtccacaaaaggatgcaaaggctggtgctgttggaaatctattaaaatctgatacttctacatgtaaggtcattgctgctgttgtatctatacccttaaaacagcgcaattctcctatcttttctctgtatgagtctttttgagataattcttctaatttatgttggaatctctctatcttttctgttaattcttctaactgtgataaatattcatccaatatctctttatacatagaattgagttctagtcctcttagccattttatatgagcaggtatccatctggatttacctccataacgataacctaatctcaatacaaatgcattgatatgttgtttgactttttttgattcatccttaaagtcattcatcatacgtatatattcctttatctcaacgtcatgatcatgtggaacgtaaactgctttatatgaaccattagctagatttgttgcaatcatttgtgcatctcttctatcatttttgatgaccttgttcttagcagaacgttgcattgttgttggtgccagaatattacatgcaattcctttttcttttaattgccaatatagagaatatcctaaacacccagcctcatagccagccaaaacatcaacatcttcattgattttcttttttgattattgatgaatttttcaataagcttaatatctgaacttattttagtttctcctaaaatttctccagtttttccataaatcgcacataaactatatgagtttttatggacatccattccaatatagattatacttttcattgtgacctcctattgtcgttatggtatcgactttcataattttgtttttgttaatcatattatgaatcgtaatccacgttttggcaactaggaggtcacttcatattatctcaaaaatattatagcagtttaaaatttatttaacatctaaaatgcatcattacagccaataacaaataatcataaagatgatcattgaaagaatgatcgaaagaacttgatttatttttttaaacatatatttcatgctatcaccactatattatatgaatgtaataatgatattagtcataacattgaactaagtgatcttattataaaaaacgaaatcttttaaaatagatttcgttttttgcctttatataaaataataaataccatcataaataagataactatatagaagaaagaaaattcattgataataagatttccagaaaataaactatttaaagatatataatttataaacgaaatatcaataattccgattcctaaaggtaaaacaaagatactacaaagtaataataaagcaagataagtgttttttagtatttgagaaattataaaagtaaatcctgctgtgatataagccatagataatctaaggatataaagtaaaatgatttgaatgatcagtggcatagaaaagcttatcttggctaattctagaattgcatgattagaggtaaatagataagttaaaccgtaacgttgtaagaggataaataattgtggaagataggtaataaaagtgcataaggtcgtaatgataaaacatattttccatttttgtttaaatacttctttttggctgtttttttggacgttgatcagttgtatcatgcctgaggaatattcatttgcaataaatggggcaaatagaataatgatagttagagttaaaaataaacttaaagtaaaatctgttttataaccgacatagctttttccgaataattctaagtatccagtttcatagataattgggtaatttggatgttttgctatatgatcaatttgttctaaaactttttgaaaagcgtgttcactgattaactgactggaaatgtagttggtaattgcatttttttcgttttctgagattttaccagactgaaaatcattttcagcttgcagactttgttgatggagttcttcaaaacgaagtgtttctttttcgatgattttttgtttttcttgatcatagggaccttctaatatcttcatataattttgataataatattcatcagttgtgacatcatagtttagattgatcgtaaaccatgaaacagcaatactaaatattactaatattataagtcctttttggatgataaataatttataacattcatggtaaaagatacttacatttgctttaaatcttttttttctatttaaatgaaatgattttaaagtatcggcagttttatttttagaaaataaatagatatttaaaaagataaaaagtaataataaaatgatcgtgataaaccaaaagatatttatgatattaataggataaccaagaatattaagatttaaataattttgatagatgggattgacaaggagataaggaatgatattaatatgttttaaaaggctgaagtttgaactggcgggtattgctaaatagaaagtaagtgctaagcctaataaaagaatagttaaaatatatatttcaatcgttctttttgatattaatgttatgaataaaaatatcattgctaataatgagtaaatacatatttttgataaaaagaatataagtaagtattgtccagatgaaatagctaatgtagaagttgtaaaactggtaattgattgaatgcttactgataaagggatagaaccatattttaagtaatttataaatatattgctgccccaaaataaaatagtagttaaaatcgttgtaaagagaattacagaagttttagcacgaatcaagccggttcgaccttctttagtggattttaataaaaagaaaagctggtgttctttttcatagatgagaagggtactaataataaagaaaataaagatcagtgctaaaagatcagtaggaataaaatcgataatattttcaaatgctttaacattagtaaaggtcaattttacattatctaatgactgataatcatttatggttttgctggcatctcttttttgaaaatcactttgatttttaaaaatagctatttttgattcttgagcactttgttttattgcaatacgcagttcaggataagaagttagggtattccattgattacgatagttattaaatagttccatctctcccataaagctattagtatatttataattatcaatattattagacatcacagcttgataatattcatcaatatattcaccttttttgttatcacttaaactactgattttattgtagcttttttgataagcatcactactataatatttattaggattagttgctaataatagaccgatatttaataaaagggcaataataagtaccaggatacatgttttatttttaaagattttatagaattcttgcaaaaatattgacattatattagtccttcatttcatcactgaaataatataaatagacatcttcaagatttgcaacagcttcaatatattgatattgaagaggtttttgattcgctaaaatccgtactaataaaccatttgcctgttgtgaaatattgctgataagaaattcaccttgtactttttttaattcctcttcctgaatcgataactcaaagacttttccttggatagttttacaaaattctaatggtgagcgatggtctaacagtttgccatttttcataagaatgacttctttagcaatatgttcaatatcagatactacatgtgtagcaaataaaacgatcttttctcttgctattttagaaataatatttctgattcgaatccgttctttaggatcaagcccagctgtaggttcatctaaaatgatgattttgggttgattcatgattgcctgggcaataaggattctttgcttcatcccgcctgaatattgtcctaaaagacgatgagcatcatcttgtaaatttactatttttaaaacattttcgatttccatcttagctgttttagcatccattccctttaaagcagccatataatttaaaaatcgataagcattaaattgttcatataattcctgctgctgaggcatataacctaatatagcatgataatctttctttaaatcattaatatttttaccattatataagatcttgcctttatttggttttaaattgccagttaataaattaataagggttgacttaccagcaccattagatcctagcagagcataaattcctggggtcagagtgagattgatgtcatttagagctaataaactgccatatgattttgtcagctgttggatttctaatttcatagtctacctccatatctaactaatttattttcactatagcataaaaaaaggaaaaattattaatttccccttttaatggttagatatctaattaaacggtattaaaagtttttttcatagaaagcttttaatactaaactctttttgcgacgactgatctcaaacaaacaattaacaccttttaaataaagctggttattaaatatttttaaaatcttctttttattaataatcacactacgattaatacaaataaaatcatttcccaaaatccttaataaactttttaaagttttatttttgattattgcttgtctatcatcaaatattacggcgatattcatatcgcctaaatacatacaatatataatactatcagtttttatttcaagtatttcaccatctatttttaaatcaatactatgttgatttttgattcttacaagcatctttgaaacactctcaactagttcatcttctaaattatttttactaacaaaaccataaacattaggtccaaatgcttctttatagcgatgattatgactagttacaaaaattatttttttatcttcattagcttttgcatactcgattccatcataatcaggcatatcaatattcaagatcataaaatcaaaatcttgattaatttcatttattgagttatatgtaaatgttctaagacaatcaaactctaataacaatatattttttattttatcacaaaatatttgttcatcatctattattcccactgtaatcatttttctctatcccttaatctctcttaatattattaaaatcccgttcttcttatataatagcattaaatcaaataatagtaaaataaaagataatatttttaaataaataacttttaatatcagaaaattaatgtattaaatcatgataatacggctatttttaaaatattaatactatattaatatcaatatttatatatttaatgatttatttttatagtggacttaaataatgtgttttatataaaatactaccatttaatgggaaatttaaccattgaatagggaaatgaataagttctttttttattgtgttatagtaaaaataagaaaagagatagtaataaaaattaatttacacaaaattcttgacactacctgattttatttttaaataatatttttgttttatttagataatataattttaattaaacgatattaattatatgaaataggtagtgtttaaaaatttttaatatggataatcatttatgtatttggattcaaaaagcttattactagctttatgataatagttttagtttatcaagaaaatttgataatatttaatctttggttttattaacatgcaacgtacgatgaaagggaggatgaaataatgaggaaacgattactatttattttaattttattattgtgcctgcaaataacagcttgtacacaaaataataatacaagaacagataatatagataagaaaactgttgtatggagaattgaagatcctggtagtatggcttctttaggcgatggattaattgaaacatgggaggaacctcttaatgaattattaaaggaaaagggagcaacttatcaagttaagatcatgacttttaatactcaagaaacagataataaaataaatgaattaaaggaattaaaaaaagatggtaatcaaactgatcttgtatcaatgatctttgcatcttataacgatacggaagtggagccttggaataatacatataaatgtgcagttgataataaactgcttatgaatttagatgaatggaaagaaaaaaataaagaaatattagaaaaagtattagtaccctatgattttgaactctcaaaaatcgataataagttatatggcatttcaagtcatgttcctactactaatggttttatgtataataaaaagatgttagatgaacatggaattaatataaaagatattaagagtggtatatttgataataatgaattgttgatacaggcaaagaaaaataatgggaatattccaattcaatttataggatttgatactagtgtgacaggtttgtgggttgtacccccaacaaataatttggcatggaaaaaaggtgaaggttttatttctttgagtcaatcaaaggagtataaaaatttattagctaattattcgtcactaaaacagcaaggtttgcttgatcaggatctttctaaaaacggcgttgttccttttgttacagcatccacaatgagtaaacgagatccatttgaagtcaatatggcttctcgctctatgccagagacaaaagatgattttgttgttatccctaatcaatctacaccaaatatggaattgtattggggagataataaaacatcaattgcatcttggtcagaaaatgttgaaaatgccgaagattttcttttgaaattatttacagataaggatattgcaaatcttattcaatatggtattaaggatcaggattacacccttgatgaagacgatcatattactgtaactactaaaaacagtggattagctatatttggatatcagtttacaaaccctaaaatcacttattcttcagattttgaagaagatgataaagtcagttactctaactggttttattcaacatatggtgataattttcctaaaggcttcagatttgatccaattccagttttaaatgaaattaatgctactaataaaataatgacaggagatttcattgatgaatttcaagaaagtgaatggatgaataaaatagctaaattagaaataaaagatctagatatattcttaaaagatatgaatagagaattagataaagccggaatgcaaaagatagttgatgaagccaatcaccaataccaggagtggttaaaagaagctgaataagatgtagcataaattaaaaaaatcatcatttttatggtcttgagcattgtttttataggtggctgtagtacaaatatatatgaacagtttggaacattagaattttcaatgaaagatggcttttatcatacaaagaatgtggttatttatattttttgattatgaaagttgtatgcagtaaagctaattataaaatggaagcagaattaaaataaaatttttaattgtttctcatttagtatcaaatattatgctagatatctaattagtttttatttcaagcatttcaccagttatttttaaatcaatataaatcatattaataagataatttttaaaagttatgaccgttcgattggatatcgaaccgttaaatggggaaatgaacaatatctttatttattatgttatagtaaaggtaagaaaagcagctaaaagaaatgataagaaagtaattaaatatgaatttgaagtatcaaaaaaatttcttttttgcattatgatctaattaatgaagttagatagaaaagatggaaataagtattagctgtttactcactagatgttcattgatcattactaacaccccctattaatgttgttgcaaagtagagttgttttaaaaatgttaggaacatcagcaaaaccaaaggcacgttatgagctgactggtagatttattcaggattatattccagggtgtgagccaagacattcaggaccttgtaatactggatattgggaatataaagtaatgccattataatattattaaagatgaagttaattaaaggaggttgtgtaaatgaaaaaaaataatattttaaatatattattgctagtattctcctttattttcattatccttatacgttatttatatgaaaataatgctatcaataactggcttgcttttattttaacgattggaataattataattttaaattactctttaataaaaagaatagttattaaaatcaaaaataaaattaaaatttaatttaaaagtgcgaaaagtatttagaatcttataagctgtaacgatttgtttacagttttttaactgagattatcttttatcaattagaggtgaacgatcattgcagctgatgaaaataggatttatttaaattatatttattttgataaaacaaattttaaagatgttaatgaaaattatggggatgatatttaaatctaaaaaatcacatcagtattagatgatagagatattgtataaggacaacttgtgagagatacattattgacagttgaaacaaagtatataaatgaaaaagaagcaaatagtgaaaaatttttcacagttatgtaccaaaagaaacagctttaaccaagtaataattaatttttaataatggaaagtggatatatctagataataaaacgcaagagatcattatataagtcatttaaaagatgaaaaaatgaatatgatccgcttttattagtaatcatactatgattaataaaataaaatttttaattgtttctcatttagtatcaaatattatgctagatatctaattagtttttattttaagcattttatcagttatttttaaatcaatataaatcatattaataagataatttttaaaaattacgaccgttcgattggatatcaaaccattaaatggggaaatgaacaatatctttattttttatgttatagtaaaggtaagaaaagcagctaaaagaaatgatgcttctgtttattatgtaaataagttatggtaacgttaaatagttttaatttcatcagataggtaaggagggaaaataaattaaagaaatgataagaaagtaatcaaatatgaatttgaggcatcaaaaaaatttctttttgttatgttttttacttactattgtaagtaatgtgtagttattatattttgggacaacgggaatgagtgatagtaaaaaagaaaataatttgaaattaaaaaagggatattggtggtggtaataattgctggtttattcaagcaaacaaaacgtgacaaatagtaaatagatatgtatttttttaatgacagatcgtttatcatgcttaaaaataaatcctttagttaaggaagaaaaatgtttttatataatattaaagttaatatgacaataataaaatgatgatgaagttgacatttattgaattgagaagaattatctagtgaattaaaagaattttttgcaaagtgagggtgaaaataagatttgttattaaccgagggaaacatgaataatgaattacttggtcatatcataaattgaaatgaatgtgtctaatcaatgaagatagacagaaaaggaggaaattatgaatagagaaaattttttaaagtttgatagttttttttcaaaaatagcatttgtttatattgtattgatcccctttttcttcctagaaagaaatagaataatatttatttgtttcagtttactgttttttatagaaagactagtacatatgtggtatataaaagataatttttctaaaactaaaaagatagtttatgcgttaatagccatgatatatattgcttgttcaataggtatagttattgagttgtttagcttgatttgaaatataaagggctgatcaaaagtcagctctttaatattaattaagtttttaaaaataatttgaaaaagggaaatacgattatgacaaagagaaatagaatgaagaaaatattaatatttttaagttttgcattatgttttcaaataatgggatgtacaaaaaagataaatattgatactaaaactgttgtttggagaattgctgccattggtaattataaagagatgacagctgaaatgattgaaatttgggaaaagccccttaatgaattattaaaagaaaaaggggtgcagtatcaagtaaaaattattccttttagtaataaaggagagaataatcagattgtggagttaacagaacttaaaaaaagtagacaacaaacagatgttataacaatacttccagaagtagaagaagataaattaacagaatggaataatacatatagatgtgcggttgataatgaattacttatggatttagatgattggaaagaggaaaatgggaaggttttagaaaaatttttaactgattatgattttgaattatcaaaaatagataacaaattatatggaatctcaagtaatgttccttctacatttggcattatgtatcaaaaagagatcttagatgaatatggaataaatcccgaaaatattgaaagtaatttatttgataatatcgatttattgaataaagtaaaaaaagaaactaatgaaaaacctgttaaagagatgggcttcagtgttggaaagacaggattatggacagttcctccaacaaataatttagcatggaaaaaagatgaaggatttatttcattaagtaaatcaaaagagtataaagatgtattgaatcagtggctttctttaaaacagcaggatctaataaatttagacgatgatgaaagtgttgtcccatttgttaagttacctgaaaaaagtatcagcagatatgataaatttacatatttatcagaatcatcaaaagattatatcgtagtgccagatggatctataccagatatggaattatattggggcgataataaaacagcaattgcatcttggtcagaaaatgtcgaaaatgcaaaagattttcttttaaaattatttacagataaagatatagctaatttaattcaatatggaactgaaggacaggattatgaacttgatgaaaataatcgtattacagtaactacatcaagtcttggtttacgaatatcaggatatcagtatacaaatccaaaaattacttattcttctatttatgaagaagatgataaagttgcttactcaaattggttttactcaacatatggcgataattttcctaaaggttttaggtttgatgctgatcctgtaattacggaaattgcaacaacaaatgatatactatcagcatactttaatactttgacagatagtgaatggacaaataaaatatatgatttagatatagatgatttagatacttttttaaaaggtttaaatgaagagcttgatgatgccggaatgcaaaaaatagttgatgaagccaatcgccaatatcaaaaatggttaaaggaaggtaaataaaatgcttgattcggttaaaaaaattacgattataatacttttatttgttttctttataagtggctgtagtacaaatacggaaaattcaaatgatgataatgtgcaagtatatgaacagtttggaacattagaattttcgacggatgatggcttttatcatactaataatagtggatatttatatttttttgattatgaaagtaaaaaagatgttcttgtatgcagtaaagctaattgtaaaatggaaacagaattaaaagaagattcagaagcttatattggctcaggtactggttttgtttgtaataataaattatatgtgattattaaaaatgatgatatagaaaaaagatattcgttgattgaatcaaatttggatcgaagtaatcaaaaagaaatcgttaaaataaatagtactatgatcttatcatttgcagtgattaaagagatagcttattttgcgattgatgaagttgtttttagcgaatcggagagtggtgcaatagttgaagaaccaaaacataattgttatcttttagcgattgatttaaaaagtggtaaagaggaaaaattaacggagtctaaaaatgattttaataattccttaaaaattattgccgctgatgaaaataagatttatttaaattatacttattttgacaactattttgatggaacaaattttaaagatgttaatgaaaataaggaaaactatgtatatgatctaaaaacaagagaattaacagctgttttgaaggataaatatattattaaaggacaactaaatgaagatgtcttcttagcactagaagctcaaaatttaatagcagatgattttaatagtgaaaaaatctatacaatttcaaaatatactttaccagactataaaactgaaatcatagcaacaacaaaagaatatccaattttaagtgaagatgaatggatatatcaagaagaaggaactgatcaatattatgcactggatctaaaaacagcagaatctaaaaaaataagcatgaataaaatcgaaaatgtagtcatatttggagatgcgaaggattattattatatagcatatttagaagatgatgaaatgaaacatggctttattttaaaatctgattatataaaaggaaataaaaagattattggtgcttattaggatagttgatgagttgtttatagttttaatgatttgtggtaaataaatgattttgatatggggatcaataattcaatgtcattaagttaagaaaatagtattccaaccagaagatacatcaaataaagatttatcttctggttttctatttttttaagctaaaaaagtacagtattgatactgcatttgacaaggtgtataatagtaaagactagtcatatctatagttaaagcacacgacagtttttggcttgacgtgtcgtgggtctgttctgccgggtcgaattggcaaaatttctttagctatcagatgatctacaggtgggatttttccacctttttttcttagaaaatgtcttattatatgaaatgatctggtaaaattcacctgatatttatattttcttttatctttctttggtatttttatatcttgaacgatacgctgactgaaattatagagcagtaagcgtgcatatatttcctgctgaatcagttttcttttcttcgcgtgtaatgcattcaacccaagagcatatttaacttgtctaaatgatgtttcaatgccccagcgtttgttatacaggtctttgatatcatccatagaaaactcttttctatcaagattagtgatgactgtttcataaacatcatcagttattttgaatcttacgattctacagttaaattcataccagggattttcttttgacataaaatcaaaacgagatttgtttggtaaaaatctatagagttgaggacaagcttttgtcatttttgtttgttttaaagtcaacattctaaacacatcaatatcaaattcaccctcaggataaggacctaatgattgagtaatacatgcacatgaagtaatatctctaacacgtatcagataaaaattaccggactttacaacgtgttcaaagctattatatgattcataatttctatcagctatgaaaatagcttttggaccattatatctatctacaagctgacagaaagcatcattttcattcatttttgcttgtccctgaataataagatcatcaaaagtacattccaataaatcataagaaggatttaagtgaaaagcagaataaggtttgaaatctcctttaccaaataaggtcgtatctttatcaaagacagtattatcaataggcagttcactgccatcaatagcgataagtctataacctttccataatttattgacatgtgttttcttattgaaattatcaaataaagttttaaaagcatcaactttgattttacttctagcctggacaaaggcagaaacagtaggagtatcaatagagaaatcattgagtttaagaagttcatcattcaaggaacctgtttccaagcaaatgacatttttcatagttgttttgaaattaagcattctttcacgagtaaaatcagtttcaggattttcgcaaaaaagtgaacaagactgagccaatttatcgagataataattcaatacgtttttaagatgtttatagctattcataatgtagtacctccgatgtatacctataaacattgggctattatcaattcagtattgataatagcccacacaatttcatatgaaagtcaatacttttatatgaaaaaacacaaaaaagaggggctcatgttttcatgaactcctcacgtgtcatcaaatccttaacttaatgacattgatcaataattccccatattttatttaactaaaatgttatctaagaattgaaaaaaagtcattgttttgataaaatcttgtaaatacatgaaaaggaggggaattatgcagttacattttacaaaaatggaaggccttggtaatgattacatatattttgatgggataaaccaggaaattcccatggacaaagaatttatcactaagatcagtgatcgtcattttggaattggcagtgatggtatgatcgtgatcttgccatcagataaatatgattttaagatgagaatgtttaatcttgatggcagtgaagcaatgatgtgtggtaatggtatccgctgttttgcgaaatttatttatgatcatcaattaagtgataaacgtgtattgaaagtggaaactaaatcaggactaagagtggtagaattgttgtttaaagatgataaatgtgtgggtgccaaagttgatatgggtaaaccaatattgacatgtaaagatattccatgtacttatgatagtgaaacaatgatcaatgaggtagtaacgatcggtgatcatgattaccctttaacaacgatttccatggggaatccgcatacagtaacatttgtagatgatttagagactttggatttagagaaaattggtcctgtttttgaacatcatgaattatttcctgaaagtgttaatactgaatttgtgaaagtagttaatgatcactatgtaaaaatgcgtgtttgggaacgtggttctggtgaaacaatggcctgtggtacaggagcttgtgctgtgatgtatgctagttatttaaataactatactaaagataaagttacagtcgaattattaggcggttgtttagaaattgaatatattaatggtacgatcatgatgtcaggatcagctgttaatgtatttgaaggaacaattgaaatatagaaaaggagagaaaatatgttaaatagtgcagaagaaattattaaatttattggcgatgctaaaaagcaaacaccagtaaaagtgtatttgaaaggtaaaaatttaccggaagcaacagagtttaaaatgtttggtggtaatgaaagtaaagtttgtattggtgatttagatgctattaaagcttatatggaagcaaataaagaaatgatcacagattcatatttagaacaagatcgtcgtaatagtgccattccactattagatatgacaaatatcaatgcgcgtattgaaccaggggcttttattagagaacatgtaacgattggtgataatgccgttattatgatgggagcagtaattaatattggtgttaaaattggtgaaggaacaatgatcgatatgggtgccgttcttggtggccgagttgaagtcggaaagcattgtcacgttggggcaggagcagttttagctggagttattgaaccacctagtgcaaccccagtaattttagaagatgatgttttaattggtgctaatgccgtagttattgaaggggttcatattggtaaaggtgctgttgttggagcgggatcgatcgtaactgaagatgttcctgctggtgctgttgtggtaggaaatccggctagaatcattaaagagaaaaaagatgaaaaaactgagggtaaaactcaattaatggatgatttaagaaaactttaggagatagatatggacgctttagaacaaataaagaaatggcgtcaggaattacatcagatccctgagctgggtttacaagagtataaaacttctaattatcttaaaacggaactgctcaaaatgggttatcagccaatctcaatattagaaacaggtgttttagtatatattgataacggttatgatcagactttagctttccgtagtgatattgatgctttaaaaataaaagaacaaacaaattgttgttttgcttctaaacatgagggttatatgcatgcctgtggtcatgatggacatatggcggcccttttaggactggctaaaaagttaaaagatcagcctagttcttttaaccataatatcttattgatttttcagccagctgaagaagctcctggaggggctaagctgctggttgaagaagggatattagataaatatcaggtaaaagctatttttggacttcatttaatgccgacgatcgatgaaggtaaaattgcttgtcgtccaggacctttaatggctcaaaatggtgaacttgatgttacagttgttggtaaaagtgctcatgcgggattatatcatttaggggtagatgcaattgtgatcgctagttcaattatttgtcagtatcaaaatattatttctcgagttatttcaccagttgaaagctgtgttatcaatattggtgaaattaatggcgggacagtaagaaatattgtcgctgataaaacaacatttaaaggaactgttagaacctatagcgaagcggtctttaaaaagatcgtagatacgatgcaagctatcaatcatggaatggaagaaagttatggctgtaaaattgaatttagctgtccaccgatgtatccacccgttttaaatgattatgatttgtatcgacagtttgttgctctggctggtaagaattatgaagaattaaaagaaccattgatgctggctgaagattttgctttctaccaaagggaagttccgggaattttcttttatgtaggaactaaaacagccaaatattcaagtggtttgcatacagagacatttaattttaatgaagaagtcttgatgcaggcagtggaattatattactgtctagcgtcaaagattaaattgggggattagaaatgaattattatgatagagctaataatgctttaatgaaagcttatggcagattcgatgttacttttgatcatggtaaaggtgtttatctttatgatgttaatgggaaaaaatatttagatttttattctggaataggggttaattcatttggttatgattatcagccttatactgatgctttagctaagcaggtacatcgtttgatgcatatttctaattattttaatagtgtagaagcaattgaagcagccgaagcggtaattaaagcaactaaattagatcaagtattttttactaatagtggaacagaagcgacagagggagctttgaaattagcacgtaaatattattatgaaaaacatggcaaagccgatagtgaaatcatcagtttgaaacattcttttcacggtcgttctacaggttctgttactttaacaggaaccccagcctatcaaacagcttttggacctttgatcgaaggtgttaaatatggtgaaatcaatgatttagaatcagttaaaaaattaattacaccacggaccgcagcaatcatcttagaaccagttcaaggtgaagggggaattcatgtttgttctcaagaattcatgcagggaattagaaatctttgtgatgagcatgacattgtcatgattcttgatgaagttcaatgtggtatggggagaacaggaacgatcatgacttatttccaatacggaatcatgccggatgttgtttgtttagctaaaggaatcggagctggttttccaatgggagcctttgttgccaatgaaaaagttggttcggctttaaaacctggtgatcatggttctacttatggtggtaatccgatggccggatgtgcttgtaaaactgtttttaaaattattgaagagaaaaaaatgttggaacatgtccaggatattagtgagtatttaattgctaaattggatgaactagtagaaaagtatgattgtatcaaagaacgtcgtgggttaggtttgatgattggattggaatttgttcatcctatcaagccatatattcaaaaagctttggataaaggtttgattttaattacagcaggtagtaatgtgatcagaatgctgccaccatttattatcgaagaaaaagatgttgatgcaatgataaaaatctttacggaagtaattgaagaagtgaatagttaaatgagattcttatttgataagaatctttttttgatatcaaaatttaaatgatatcttaaaataaaaattgttgattttaaaatttcaaaaattatactgtatgcaataatcatttacacagcctgttatattactgcctttgaatggttaaaatataaaataagaagggagtagtatttgtggagatagattataaagcaattggacgaagggtgaaaagtgcaagaatcaaaatggggatgactcaggaatttctttcatatctaattgatgtgacccctgcgcatatgagtaatattgaaacaggaaaaacaaaagttagcttgccaacattgattgcaattgcaaatgcgctttctatttctgtagatacacttttatgtgataatgtattgaatacaaaaataatatttgaaggcgaagcaaaagaaatatttagagattgtgatgaatatgagattagattgttagtggagatattaaaggccgccaaggaagctatgcgtcgtgaaaaaataataagaaatagatttaagatgtagaatattatatcttttattaacattttcaagctaaaaagaagtaatttatcttttttagtagtaaatgataataggaggttttaatatgcgtagatatccaatatatagacaagataataattatagctgtggagcatattgtattaaaatgattttaaaatattatcattatgatataaagacaaaggaaataaaagagcgctgtcgtttaacgagtgaaggaattagtgtatatggactaatatgttgtttgaagtcgtatcattttgatgctaaagcgtatgaatgtgatttgaaaacattattaagtgaagctaagctgccttgtataatacatattattaatgaaaatatgacacattttgtagttttgtatcaaataactaaaaaatatcttttaattggagacccggctcaaggattagttaaattaactgaaaaagaagttgaaaaagtatttactggagtttgcatttgtattgaacatgtaggaagatatattattaagaaaaatcaaaaagaagtaggatttaaagaatttataatcaagcatttaaaggatagttattataatatttttaagttattaatgaaagcggtagcgatatcactttgtagtataattggttcattttattttcaaggattgattaatatgcttgatgaagtggatttttattttattatgggctttagtgcagtttttatatttgtagctggaattaggatcatcatgtgttatcagcgtaaaaatttggagattgagatccaaaagaaactgaattatgagtatgtaaataaaacggttattaatatgctggaactgccttttaagtattttaattgtaatcaagagggagtattgttaactaaagttcaaaacttgtattctttaagtgatttttttattcatctttatcttacgatatttatggatctggttttaatgagtggggttattattgcaatactacttttttctttacagattggatcagtggtaataattgttttaattatgattgcaatcgttataacaaaaggaatgaaaagattaaatagattaaataagaaaattgttactagtcaagagcagatgaatcaaggatatttagaatatttaaaaaatttttataacagtcatcagttttttttaaaacaatttactaaagaaaagataaattacttatttgatgagtataattataatgtttattggcgagataaaagtttaaatgatctaaatattattagtgagttattgattcaaggattagcttttttagttgttatgatagctgcttattattataaaaacgggtatattaatattggtgatattgtctttttctatatgttgacaacatatttgatcgagccattattcaatgtaattgcattcattattgaaaaagatgaaattatgatcttatatgagcgttataaagaaatcgtaccagataaaaaggaacgaaagttgaaaataaaaggtaagataaaggaaattaagtttgatcatattacatatagctatggctatagtaaaccgatcattgatcatctggatctagttataaaagattcgatatggttaaaaggcaacactggtgctggtaagtcgacattattaagactgttgatgaaacatgatgatttaattaaaggccggatattgatcaacgggataccactggttaatattgatcctaattcgctgtatcaaaaaattatttatttagataaggaaccaattttttatcaagaatctttacgttttaatctccttttaaaaagtaaaaaaaattatttattagaagaattattaagagagtttgcagttgatcaatttattgatcaattagaaatgacaattgatgtagagggtagaccgttatcatcaggacaacaacaaatcatgatgatcattagagctttaatattaaatccagatgttttggtgttagatgaagctttgagtaatgtagatgattatcgggttgaaaagattttaaattatcttcgtaattgtagaaaggaaataattgtgatcatcgttgcccatcaaacaaaattagtgaatcaattttatgactgtgttataataaaagacggaaaaatttcttaatatttaatgaaatttttgaagtaattctcctttttagattgtaaaagataatgaggaggaaaaaatatgattcatgaaaaaactgttatcgataataataatattcgctttaataatgacctgttctttaaatacctgctttccagagatactttagaatctataaaactgagaaagtttatcgttaaatctgtcactcatcttgactgtcagcaaatgatcgttaaaaatcctgaaatcaatcaaaatacggttctcgctaaaaacatcatccttgatatttgtgccgttgatgaaaagggccgaatcattgatatcgaaatacagatggccggcaacagtaatagcgaaagcactcgctttcagttctatggtgccagactgttagtagaacagatcgataccggtgaaaaatatcatcagctaagaccggtatatcaaatcatctttatcaatgaagatgatgatcgtttgatcaaagattatgcatttcgagatgatcagggagagctggaaaaagaaaatcttaattaccgctattttatcaagatgagacatatcgataagatcatcaaagaaaaaggaattgaaggattaaatgatctagaaagattatgttatctgtttataaaaaatgaatacactgctataatgaaggaaagagaagaagatatagtggagatggtgataaagatgtatgacaagtttagaagtaatgagccgatatggtcattagcgaaccagttagcgttagcgaagcttagaactgaatccttagagatggaacgcgaagaaaagacagccaaaaggatcgaagaaggaatcaaaaaaggtatcgaacaagggattgaacaaggtattgctcaaggagttgagcagggtattgaaattggccgtgaagaaggaatcggaattggccgtaaacaggaaaaagaagaggaaattaaaagaaacaagaataattgtattgaattacttaagggaagatatcaaaaagattgtagtaaatgggtagaaggattgagtgaaaaacaaatagatttaatctatcggcatatatttgaagaagatgattttgcaatgtttaagaaaaaaatagaagaggaatattttttgaagtgaggtaaagtaatggaaatagattttgcattggtaaatgaagtagaaggatttgatgaagattatcaacaaatttatttagaaattattaaagaaacagttaatcagttagaaattgatgaggatttagaattatcgtgtattttagttgatgatcaaaagattcatgaaattaataaagaatatcgtaatattgatcgttccacagatgtaattagttttgcattggaagacaacgagcagtattatgtgtcagggatgccaagaagccttggtgatatttttatttcaattgatcatgcaaaaatgcaggctgaagaatatggtcatagtttaaaaagggaaatgtgttttttatttacccatggtttactacatttattaggatttgatcatatggaagctgaagatgaaaaggaaatgattgctatgcaaaaagctattttagaagctttggcgataggaagataaatatggatcatcaaacaattattgaaaaagcttttgtggcaagtgaaaattcgtattctccatattcaaaatttaaagtaggagcctgtgttgaaatgaatgatggaaagtatttcatgggtgctaatattgaaaatgctgcctatggttcaacgatgtgcgcggaacgaaatgctgtgtatggagcatattgcaatggatatactaaaaaagatattaagttattagcaatcgcagctgatagtgcgacgatcgtttcaccgtgtggagcatgtcgtcaagtattaaaagaactaattcctgatgagtgtcaaattatcttggctaatcgtcagggatataaaataatgacaattaaagagctattaccaatggcctttacagaggagaatttataatgtttaaatcaggatttgtaagtatagttggtcgtcctaatgttggaaaatcaacattattaaattgtatattagaaactaagctggcaattatgtcagatgttgctcaaacaacaagaaatacgattcaaggaattcatactgatgatgatgcacaaattatttttatggacaccccaggaattcataaaccccaggatcgtttaggaacttttatgaattcaactgctttaaatagtatttttggagttgacatagtattgtttttggctccggccaatgaaaagattggtcgtggcgataagtttattgttgaaagattaaaagaagcagatggtccggtatttttggttttaagtaagatcgataccgttagtaaagaggaattagtcttaaaacttcaagaatggcagacattatttgattttaaagagattgttccggttagtgcaaaagataatgataatattgatttattattgaatacgataaaaaaatatttacctgagggtaatatgtattatcctaaagatcatttgacagatcatccggagcgttttgtaatggccgaatttattagagagaaaattttatattttactagagaagaagtacctcatagtgttgctattgtagttgagagaatgcttgaagatgaagatggagttgaaataattgcaacgatcgtttgtgatcgtaaaagtcaaaagggaattattgttggtaaacaaggttcgatgatcaaaaagattcgcttaaatgctcaacgtgagatgaagcgttttttacaagtaccggtgcatttagaattatttgtaaaagttgaaaataattggcgtaataaacaaaaatatttaaaagaatttggttataacgaagatgactactaatggagaagaaagtgttattggatttgtattaaaaaataaatcttataaagaaaatgatatgctggtatggatatatactaaagattatggaaaaatggctttaattgcgcgaggggttaagaaattaaagagtaaaaatgccccagcttgtcaaacgataacattatctgattttatctttatacctagaacgggtttatcgacattaataaaggcttcaccgatagaatattttcgtcatattaaagaagacattgaattagaagcatatgcaagttattgtgtggagtttgtttataaatatactaaggataatgatcctgattatgaatgttatcataatctatcgttagctttgaaatatttggaaaatggctatgatccaaaattagtatatttattatttaatgcttttattttagaaataacaggatcaggattagaagttgaacaatgcgtacactgtaatagacaagatcatattgctggtatttctatacatggcggtggatttgtttgtcaaaattgtattggtttatatgatcgaaagttatcagtagatgttttaaaaggttttcgttatattaatatttgtaaattagaaaatattgataaattgcacttagaagaagatgtgatttatcaattgatagagatcatggatacatatatagatgaatttacaggattgacttttcaaagtcgtaaatttattcgtcaaatcaataatttgtaaatgagagctacacattataaactaaaaatattaactaaatatgaaaaatagacaaaagttggtataacttttgtctattttgtttattttttgtgattttacgtatataattaataaatatagaaagagggataatcgtgagtgaatttttaccagtaaatcgtcaagaaatggaagcaagaggctggaaacagcctgattttgtatatatatgtggagatggatatgttgatcatccatcatttggggcagctattatttgtcgaactttagaaagtcatgggtttaaggtttgttttttggctcagcctgattggcacaacgttgaagagtttcgtcagtttggtaaaccacgactaggatttttgatatcatcaggaaatattgattcaatggttaatcactatactgttgctaaaaaacgtcgtcataaagatttatatacaccgggcagtgaagggtttaagcgccctgatcgagcagtgatcgtttatagtcagatggcacgtcaagcttataaagatgctaatattataatcggtggtattgaagctagcttaagacgcttgggacattatgattactgggatgataaggttcgtaaatcaattattatcgatgctaatgctgatctactattatatgggatgggtgaaaatagtattattgaagtggctgaagctttggatagtggtttagaaatcaaatatttaacttatttagatggaacagtatttaaaactaaaaatcttgaagatgctcatgaaccaatcatgttgccaagttttgaagaaatctgtaaagataaaactgcttatgcaaaatcatttcagattcagtatttaaatactgatcattatagtgctaaaacattagtagagccatatcaaggctggtatgtggtgcaaaatagacctaatcgaccattaacgcaacgggaatttgatcgcgcttattcattggattataatcgaatgggacaccctgattataaacatattccagctattgatgaggttaaattttcattgataagtaaccgtggctgttttggctcttgtaatttttgtgctctagcttttcatcagggacgaatcgtgcaaactcgttcacatgagtcaatacttgctgaagcaagtaaaatggtttgggatccagagtttaagggatatattcatgatgtaggcggaccaactgctaattttagacagccggcatgtaagaaacaaaataagtttggagcctgtccgacaaaacagtgtttatggcccaaaccttgtaataacttagaagtaagtcatcaggattataaagaattattaaataagttgaagatgctgcctaatgtaaaaaaagtttttgttcgttctgggattcgttatgattatttaatgtatgataaagatgatagtttttttcgagaattagttcaaaatcatattagtggtcagctaaaagtagctcctgaacatattagtgatcaggtcttagataaaatgggtaaaccacgtcgcggtctatatgaaaaatttgttgataaatattatcgtttaaatgaggagtatcataaaaaacaatttttagtaccgtatttaatgtcatcgcatccaggctgtactttagaagatgctattgaattagcggaatatttacgagatattcatcatcaaccagaacaagttcaggatttttatccaactccaggaactctttcaacaacaatgtattatactggtttagatcctcgtgatatgtcaaaagtatatgtacctaaatcagctaaagaaaaagcaatgcaaagagcgttgattcaatatcgaaatcctaaaaattatgatttagtatatgaagccttgatcaaagcaaatcgtcgagatctaattggttttggtaaaaaatgtctaatcagacctagaaaaaatagtcatcaacaaaattatccaataaaaaataacagctatcaaaaacggaggagataatcatgaaatatagtgaaacttttacatcgacgactaagacgcatgtgaattttgatatttatcttcctactgtaatgattcgttataaagcaataattcaaattcatcatgcgatgggggaacatttgggacgttatcagcgttttgctgagtacttggcacatgatggttttgttgtagtggttagtgattttccaggtcatgggatgtcattatataattatgaacaggggtattttggttttggggatgcgactaaaaatttagttgaggatatgcagcgtcttagaaatatcatggctgctagatatcctgatctaccatattttatgattggaaatgaattaggttctattgttttgcgtaaatatgtgtcgatttatggcgattatgtacaaggctgtatatttatggggacttgcggaaaattcagtaacataaatcttagcaaaatattattgaaaggtgatatattattgaagggaaatatgcatcgttcaaaaattgttaagaaaaaaattattaaaatagaatcgtacataagtgctgatacaaatgaattagagcagtatttgcaggatccttttactgattttatttatactaatcaggcctataatgatattttaaagttaattaaagaagtaactgcatatgagacaataaaaaaaatacctaattatttgtctgttttgattgtttcgggatcaaaagatgtttttggtaaattaggaaaaggacctaagtggttttatgatacgcttttaaataatggtgtaagagatctttcaatcaagttatatgaggatagttatcatgatattttacatgatcagcagcgtcgagaagtgtacaaggatattttagagtggtttaatgatcgaacgtatgtttagaacccttatagttggttgacaaaaaaccactataagggtattttatatgtgcataaaaataaaatatagatatataataataaaataggcttgactatgttcaagtctttcgttgtttatatatttaaaattcggtggatgaaggagtaaattatggcaaataaagatatggataaattagtgaatcatgctaaaacttcaggatttgtttatcaaggatctgaaatttatgatggtttagcaaatacttgggattatggacctttaggggtagagatgaaaaacaacattaaacaattatggtggaaaagattcattcaagaatcgccatataatgttggtttagattctgcaatattcatgaatcctaaagtttgggaagcaagtggacatgttggaggattttctgatccattgattgattgtaaagagtgtaaaacaagacatcgagctgataaattaattgaatcattcgatccaacagttcacagtgaaggctggtcaagtgaagaaacagtgaaatatattaaagatcataaaattgtttgtcctaactgtggaaaaagtaattttactgatgttagacaatttaaattgatgtttgaaacaagaatgggggttgtagaagatgccaaatcaacagtgtatctacgtcctgaaacagctcaaggtatttttgtgaactttaaaaatattcaaagaacgactcgtaaaaaagttccttttggaattggacaaattggtaaagcttttagaaatgaaattacaccaggtaactttatttttagaatgcgtgaatttgaacaaatggaattagaatttttctgcaaaccagatactgatctagaatggtttgaatattggaaaagttattgtaaacaattcttaaaggatctaggtttaaaagaagaaaacttacgttttagagatcatgataaagaagagttatctttctattctaaaggtacttgtgatgttgaatataatttcccatttggctggggagaattatggggcattgctgatcgtactaattatgatttaacacagcatcaaaatcattctaaaaaatctttagaatatttagatccaactactaacgaaaaatatattccttatgtaattgaaccctcagttggagcggatcgtttattcttatcagtgttatgtgatagttatgaagaagaaacgttagaagacggtgaaacaagaatcgtaatgaagttacatccagctgtagctccatataaggtagcagttttaccattaactaaaaaacaaagtgataaagctgttgaagtgtatagtatgttgagtaaacatttcagttgtgaatatgatgttgctggacaaattggtaaacgttatcgtcgtcaagatgcgatcggtacaccatattgtgtaactgttgattttgatacgatggaagataatagtgttacggtacgtgatcgtgatacgatggaacaaattcgtttatcaattgatgaattagtggatcatattagtaaaaaagttatattctaataaggaggagcatagatgccaagattatcagcagaaaaaattaatgagatcagacaaagtgtcgatatcgttgatgtcattggtaactatctctctttacaaaaaaaaggacgtaattatgtagctttatgcccgtttcacgatgatagtcatccttcgatgtcaatttcaccagaaaaacaaatttatatgtgttttgtctgtcataatggcgggaatgtttttacttttttaaaaaattatttgaagatttcttacatcgaagctgtaaaaatggttgcttcgatggggaatgtcgatattagtgaatatcatcttgaaaaaagagttcagcctgttgatcaacgattagagccgttgtataaaatgcatgatgaagctaataagatctataaccattatttaaatactaaattagctttggaagctaaagaatatttgactaatcgcggcataacagatgaaattattaatacttttgaaattggatatgcacctagtaatgatgttttattaaaggcatttgaaaaaatgaattttgataaagtagcgatgtttgaatctggtttgatcattgaatctggtaaaggatatgaccgtttcactaatcgaatcatgtttccattatatgatcctggtggccgagtagtaggatttagcggtcgtatttatcagacgagtcaaaatgaatctaaatatatgaattcacccgagtcagatatttttatcaaaggtgaaacactatataattatcaccgagtgattgaagaaacgagacaagctggttttgtaattgttacagaaggttttatggatgtaattgctttgtataaagcgggaataaaaaatgcagtagcaatcatgggaacagctttgacaaaaggacagataaaactattaaaacgcctttgtaaaactgtatatctttgtttagacggtgatcaagcgggaaaaaacgcaacgattaaaagtattgatattttgttacaggcagattttaatataaaagttattgatttacctgatagtttagatcctgatgaatttttagataaaaagggaaaagaagaattgaacgctttattaaaaaaaccgataacgtcattggattttaaaatgaattattattatgagatgacgaacatggataattatgaagatcgaaaaaaatatttagaaatgattactaaagaaattagtgatcttgatgatatgatcgatcaagattattatatccagcaattagaaaaaaaatctggtttttcaaaagaaacgatcttaaaacttgtaaatagtaaaacgagtaccaagatcaaacaaacaaatgattatattccctatcaaaaaagtgttcgcttaattgataaatatgcaagagcggaacgagatttattatattatatgatgaatgataaaaatgtcgcaattatgtatgaagcaaaagcgggattcatgtttaatgatacttatcgaatcattgcttcttatatagttgattattatcgtcaggaagttgttttagaagttgctgatttaattagtagtattgaagatgagaatcttgttaaaaatatagtggaaatatcgcaattagaattgcctaaattagaggatacaaaggcaattgatgattatattgagataattaaagaaaatactgtaaaagttaaaatagaagaattgaaaaaagctttaaaagatacttttgatcctaagcaaaaagctcagatcttaaaggaaatcatagcattaaaagataaggagtagtgtatgaagaaaaaaaatgtagcagctgtatcatttgatgatttaaagaaaattgttttggatgatgcaaaaagtggagatgggattttaacacaagatcaaattgataattatttatctacttatgatttaaatgatgatcttgcagaagaattattagaatttattggcgaaaatgatattattatttctgatgatggattagacgatatagatgttgaagatgatttattattggctggtgtaccaggaaatttagatgtagatcttgatatagatgatgatctaggtttagatgatgatactcctgatttagattttgctggtgatttcgatatgatgacaggagatacacttcatatgtatcaagttgctgatgctgatgctgaaatggatcaaaatcaattaggaagtaatgttaagatcaatgatccggtaaagatgtatttaaaggaaattggtcgcgttgaattgttatcacatgatgaagaaatcgatttggcgaaaaagattttagagggtgatgaaactgccaaaaaagaattagctgcagctaatttacgtttagttgtttctattgctaaaagatatgttggtcgaggaatgttatttttagacttgattcaagaaggtaacatggggttgattaaggctgttgaaaaatttgattatacaaaaggattcaaattctcgacatatgcaacctggtggatccgtcaggcaattacaagagcgattgcagatcaggcaagaacgattcgtataccagttcatatggttgaaacaatcaataaattaacgcgaattcagcgtcaattgattcaagaattggggcgtgaaccaagtgctgaagaaattgctgaaaagatggacggaatgacacctgaaaaagttcgcgaaattcaaaagatttcattagaaccagtttctttagaaacacctataggtgaagaagatgattctcatttaggtgattttatcgaagatgagggagctatgtcaccagatgattatgcagcaaatgaattacttaaagatgagttaaatgaagttttactagaacttacagatcgtgaagaaaaagtattacgtttgagatttggtctagatgatggacgaacgagaacattggaagaagtaggtaaagaatttagtgtaactagggaaagaattcgtcaaattgaagctaaggcattacgtaagttaaaacacccttcgcgttctaaaagattaaaggattttctagaccgttaagatgaagttatcaaaaagattacaattaattgccgatgtaatcatcaaatataaacaaggaagtgttttagctgatattggaacggatcatgggtatttgccttgttatttagtagaaaataaaattattgcaagtgcttatgcttgtgatgtggctaaaggaccgcttgagtcctctaaagaaacaatcaagcagtatgcgttagaagatcgcgtttttccaatgcttggaagtggtttgaatccgattttaaatcgtaaagttgatatgatcagtattgccggaatgggtgcctatttaatttgtgagatactagatgaacatcgtgaatatttaagagatgtaaaagtattatttttacaatccaatgctaataacgatcatctaagaaaatatttatttgcaaatgactggatcatcattgatgaacagatggtaaaagatgctggacatatttacgaagttatggtagtaacagcaagaaagaataaagcaattacttataatcaaaaagatgaagagtttggacctatcctgatcaataaccaaacaccattatttaaagaaaaatggcaaaaacagtatcaggtatataaaagaattcaaaatacattgtctcaagatcatccccgttatcatgagatagataataagatgaaaatgataagagaggtattacatgattgcttatgaaataattaattacttagaaaattattttccattaaatttacagcagccatgggataaatgtggagtacaaataggtgatatccatcaagatattaataaagttatgatttcgttaaatgcggatctacaaagtttgcaattagctattgataatgattgtcaaatgttgattactcatcatccgtttttcttagaaaaaattaataatttaagttttgataatcatcatggtaaatttgtacaattagcgataattaataatattattgtttatagcctgcacacttgtttagatcaaggaaaagatggtatttccatgaatgactggttgatcaatgaattagatgttcatgatgtaaaatgttatgatgatattaaagttggtaaacaggcaattttaaatgtcccttgttcaacaagccaattagtatctaaaattaaagataaatttaatttaccagtaaaatatgctggtaaagaaaaaatgatttctagtattgcaatatgtggtggcagtggtgcggaagacattgagcagctggcaggtaaagttgatgcctatattacgggggatactaaacatcgtcatgctaaatatgcgatagatcatgatattgttttgattgatgttcctcatcatattgaagtaataatggaaaaaaagcttaaagaattattgaaaaataaaaatattgaagtattaacagcaaatattaatgattactatatatactagacgatcgtcatgatcgtctttttagttaaaaattttactactctgtgtatgattttactactttatagatgttataatattattatataagaattttcttatataataattaaagaaaggggaaaatgaatgaaaaaatttgtaaaattatgcttagctggaatcttatgtttaagtactgcagtatcttctaattgtagaatctgggcccaagaagatagtaagatcacaaacattacagctgaggggaaaagtagtagtggtcatgaacctgcgttagcaatcgatggagatataaatacttattatatgacaccatcttctagttcgatggatgaccattatcgaaatattgatttaacactagatgggttatatgaactttctaaaattaaaatctataataatgaaggttcttataatcattatcaaatttatgcatctacagatggtgttaattatgataaaattgcttataaaaatgatgatgcgatggcaaatgccaatggtgatgagtatatagtagatgttgaggcaagccatattagaatcaatttaagttataattctaaccaaatggaaggaaacttagctgaagttgaattatttggcgatagaatcggtgaagcagttgatatagaagataaaatcaatgaagttgccaattttgaagatactgagtgggccgatgagtatcaaaaagttgctaacgatcaagaatatgctaataataaaacaattaaagaaatgtcagcattagttggtcgggttattggtgatgagtggcaagattcttttatttttgaaatgagagattctaatgatgacaaagatatttttgagatagaaaatgacgctaatggaaagatcattattcgcggaaataacggtattgccatggcttcaggatttaatcattatttaagatattattgtaatgttgattacaatccagtttttgtttcacaattaaagatgccagagacattaccacaattagatagtaaaattgtaaaagaaacgcagtatgattatcgatatgccttaaatttctgtacttattcatatacaatggccttttgggattgggatgattatgaagtctttttagattgggcagcaatgtcaggaatcaatacaatgttagatattgttggtcaagaagaggtgattcgtcgtactttaagtgcttatggatatagtgatgatgaaataaaagaatatatttgcggacctggatattttgcctggttttatatgcaaaacatgactagttatggtgggaagttaccaaataactggtttgaaaatcgtgttgagttgggacgtaaaatgcatgatagaatgcaaacatatggcattaccccagtattaagtggcttttcaggacaagtaccaactaatttcaaaaataaatattctgatgtccaatatgtagctcaaggaaactggtgtggttatgaaagaccagacatgcttagaacttatgtagataatggcggaaaagattatttttcagaaatggctgatattttctatcaagcacaacgcgatacttttggggatataactgatatttatgcagttgatcctttccatgaaggtggcaaaattggggatatgaattatactaaagtatatgaaactgtccaaaagaaaatgatggaaaatgatgaaaatgcaatttggctgattcaagagtggtcaggaagtattgccggaaatactagtaaattaacaaatctagataaaaatcatgttattgttttagatttattttctgaagttagtcctagaaattcagcattagaaggggcaagtacaccttggatctggaatatgcttcataattttggaggacggatggggttagatgctaatcctgaaaaagtatctcaaaatattcctaatacatatcaaaatagtaattatatggtgggaattggaatgacacctgaagcaattgagaattcaccaatggcttatgaattgctttgggatatgacttggagcaaagatccaattgattttagacaatggagtcaggattatgcaaaaagaatctatggtggaactaatgaagatatcgaagaggtttggaatattctattagaaacaggttataatcgtaaggatagctactatcaaggagcaccagaatcagtaatcaatgcgcgaccaacaactaattttacttctgcatcttcatggggacatagtactattaactatgataaagaaaaattagaacgcgcagtatatttattagcaaaaaattatgatgaatttaaagatagtccagcatttatttatgatctatcagatattactagacaattaatttcaaattcagctcaagaatatcacgcagcaatggtcagtgcttatcaaaatgataatttagcagaatttgaaatactatcagataagttcttagaaatgattttattacaagaccagatcttatcaacgaattcagactttttagttggaaactggattgaaaaagcaagaacgatgttagatgatagtgatgactggacaaaagacttatttgaatttaatgctcgtgatctaatcactacttggggtggtttgaaaaatgccaatggtggtggtcttcgtgattattcaaatcgtcaatgggctggaatcacaaaagattattattatccaagatggcaaaaatggatcgaggatgtaaaaacagctatggaaacaggtagtgctgtcgctaccacaaattggtttttaatggaatggcagtgggctaatgaaaaatctgatgaaggcaatgattatagcacaactccagctaatttagatttaagtcaattagcaatgaaagcctataatgattattcaatttcaagcctaaaacaattagttggtaatgtagaggaaaaagaaaatattgcattaggaaagaatgtcagtgcttcaattaatagccttgtttctaatccaactactaatttgacagatggtaacaaagaaacagcctgggttggtgaaagcaatgtagcacaatttgatttaactgttgatttagaagaagaatcaagtattgatggtatggaaattgctttaaaacaggttgccggaggtttcccttatagttataaagtagaagtatttgaaaaaggtgaatggaaagttgtagccgaaaataatgatggacaaataacaagtcaaactttaattgattataaaggaatagcaagtaaagttaaatttacttttacaacaactgatacaactattatccctgaagtaacagaattacttatttatggtaaagtagcccaaaaggttaattataaaaatcttgctgcaggtattccagtaacaacacctgaaggagttactgataaaattactgatgagaatacaagttcactatgggtaagaaatggtgataaataccctgctttattaacacttgatctaggtgaagaagcatacgtagatgttttagaattatattttgaaaaaccaggtttaagatatcaatatgatgttgtgattgaagatgctagtggtaatcaaacagttattcaagataaatctgataacacagaagatttagcaggtatgtataaattaccagttaatcaaatggttcaaaaagtttatgttaacttaaaagctagagctcaaggtggtgaattttatttagcctggccagcattagcggaaatcaagttattacaagaaacggaacttgaatttgaataccaaaatattgcttatggtaaaccaggacatgtaattaataagaattcttatgatactagcaaattgacggatggttcaattagcggtttagaaaatgttggacatgatgattttccaactactttccaagttgatctaggcagtgatcagtttattgaagaagtaaaaatttattttgaaaagccaggaatcagatttaaatataaggtcgaggttgaagatacgtctggtaataagacggtaattatggatatgacagataatcttgatgatatgcagtcagaatatacgattcctgctaaggtaagtggttctaaagttaatgtagttattgaaggaagagcgccaggtggtagtttctatttggcttcaccagcaatgacagagattgaagtattcgctaaaccaagtaatgttattagtgatagtgaaattagtgctaatatttctttaagtgatgaacaaaaaaaggcattagttgacaatgataacactacaagtgtcgaatttgatagtaatgatgaaaaagaaattgtttttgcttttgaaaaaccagttgatatttatgcttatgaattatataaattaagtaatgaagctctacaatataaaatcgaatatttatcagtagatgacagtgaatggtctgttttaattgatgaaagcaataatttaaaagacagtaagaaatatgttgaagaatttaatgctgtattagctagcaaaatacgtttaacaatttataatgatagtgctgaaatttccggatttaatgtttatcgtcatgatgcaacgatcgaattggcttcttatatcactacgttaaagaataatttagctaagttcacgattggagaatatgcgggagattatgcagcagctgctaaacaagtattagaaaatattattggtgatgctgaaagtaaacttgatagtaatattaattctttagaagtgttagaggaacaagaaaagttagaaaaagcatataatgaatttttaagatcttatataagcattgatagaacacctttattagtagaattagatgaagtaaacaagttattaaaattagaaagtctaaaagataatgaaaatttaaatgatgcttatgatagtgctaaagccatttacaatacatacaaagtaactcaaaatgaattagatgcatgtaaagaaactttacaagcagctaaagaagaggcgttatcgttattatctaatcaagaaatatatcaagaaaaattagctgtagctaataagttgattgaagatactggaattggtgaatataatggtaatgtttctaaagaaacgatggatagtttaataaatgctgttaataaagctgaaaatgattatgttaatgtaaatactgcaggtgatttaaatataattattagcgatttgatcaatgctattgaattatttgaaaacaataagatcattgtagataaaacagctttacaagaagcaatcgacaaaacaaataaacttaatgaagatgattacacaaaagaatcatggcaaaaagttgatgaagcattacaaatggctaataaagttaatgaagaaaacagttcattatcagaagtagaaaatgctaaaaatgctttattagaagctattgataatttaatagatgctgatttagaagtagagacaaataaaattgcattacaaatggctgtagatacagctaatacattgaaagctcaaggagctttagacaatgtcgtaccagctgtcgttaatgaatttgaagctgctttaaaagaagcagcggaggttttagctgataagagtgttagtcaaacaacagttgatacttcattctatcgtttaactaatgcgattcatatgttggaatttgtaaaaggtgataagactgctttagaagccttgatcaatgaagcaaataattatgtagaagaaaactacaccccagattcatggacagcattcaaagaagccttagatgcagcaattgaagtcatgaatgatgaaaatgctttagaagctgatgtagtagaagcgttaaataacttaaaagatgccatgacaagcttagtgatcagagttgataagacaagattacaagaagcatatgacaaagtaaatggcttagataagagtctatatacagaaggaagtgttgccaacttagtagaaccaatggcaaatgctaaagccgtattagaagattcaaatgcaacacaaacagatgtagataatgcatatgaagcattgataagagcatacttagacttaagattgattccaaataaggatctattacaaggattgatcaataaggcaaatagcttaaatgctgcaaattacagtgctaagacatggtcagtgatgacagaagcattagatgaagctaaagcagtattaaatgatccagaagcaacacaggaacaggtagataacgctaaagaagtattaacgaaagcgattgctggattagaagtaaatgaagcaagtaatccagtaaaagccggtgatacaacagcaagtgtagctactggagataatggtttgattggtatttatgcaagtttatcagttttagcagttgcgggattaagtttattaagaaaaaagaattattagaaaattgtatagattttaactcgatgagagatgattaaaaaaagagatttcattgtttagtaggttcttactcgataatgggtaattaaaaagataagcttttaaaaatgacggtatttattagtcttttaagaaatggcattttaatgtttaccctaaagtaagaaagaactgtttagtaagaaatctcttttttacacttattttaataatttaagtaatttttataaactatttaatcttttgtttaaaaatcaaataattgaataaatttttgccataaagatttagatttagtttgctttttttctttaacttttatttcttttttttcaatagctgcaattttgataacaaattgaacattattgacatttgtatttttttcagaaacaaaagatgtgttttttgttttttctcctcgtatagaagaaagtatctcattaattttattttctatttcgatgtccatttttgaagtcttagagcttagttcatttgtaccattatttaattcttttattccctcacaataagctgtaatacctgcatataatttggatgaaccagaaacaagactatttgaaccatttagtaattctttactaccagaagctaaagaagaaacgccttttatcatttgattatatccaaaaacaatagtagctactccattagtataattatttattcctttatcaaattctttataattgacaacaagctgattaattcccgatgctaattctgacatttttgtaagcatattactaagagtatttataaattcagatattgcagtatcaaatttattatattcattttctagtgaagttacaccggtatataagtcatcgatatctttggaaaaagtgtctaaataattttttgtaccatttattgctgtagtatttgcagttaataattgaatcatattttctaaatttgtgacttgttcttttaattgggctatttgattttcaaacccactttgattttctaaagtggcaatcgtttgttttaatgattctatttgatttgtacaatctgtgattgtctgctgattatcgttttttaacgaatcgatatctaatccattttgtgacatcattgttttatattgggaatatcccaaattattttttagagctgctatgccatcagataggttgttaataccattttttatcttactagaagctgaagttagttcttgaagttgatccgttgaaaaggaaataatatttaaacttgtttggatagtttcaagtgtgtcttttatttgcaaagaactttttgttaaagttgatgattgattgtttaaagcatcaagcccgacttgtatagatttcatgctgtcttgaagtactgtgattccacaatctaattcacttgcaccattttgtaaagaagaaactccgttattcaaagaatcactactagtttttaaattttttgtaccatcataaagttgagttgtaccattatttaatgtttctgtagctttcattaattcttcaactttttccattaattcattattatcgatctcaatatttaagtttagctttataccatttattgatacaggttccatttcaaagtttttaacatcggtataaatagatgtttctaaccctttttggggaagaattgtatataataactgtttatcagcaccaacattagccattgttgctccattggcttttatattgttgcaaagattagtatctagtaaaaatgttgcttgtaaagcataatcattaaaatatgaatcattacatttttcatttttggtaattgaaattcttatttctaaagcaccacttttaccagcaatttctttagcagtatattctttgttatctagaaaatatttaatggatatgttccatgggatttctttattttttaatgtaccttgatagtatacttttttagctgaagatgaaaaagtaattttatttcctttttgattaattttatctgtagtatttaatattttaactgatgaataatcaccataatcactaatattaccaccatcaaaaatattaacaacgttaatattttttactgtcccatcagcgttactcataatatatactatttcttctttggcagaatcattttcagcagccaatatcggaattgtagtatttgttgtcattaaaattgcaagaactataacaataacttttttatatattttcattttgtaatacctccttatgtttttttataactaatccatcaaaaatatatagtaaagctggcagaacaaaaagcactatgataagagaacaaactgttccttttccaagaaggaatcctaattgtgaaagtagtccatgagtggaaatgtttcccaataaaaatcccacgattgtcaaaactccgccagaagttaaaatagaaacggtaacagaagaaattgtactaattattgcttgctttttattgttagtaattcgtttttctttatatctatctgaaaatagtattgcataatctactgttgcacctagttgaatagaattgatgattaagtaagcaatatagaaaatcgtactatttgtaaaataaggaatagataaatttatccaaattgctgtttcaatagctaacactaaaataattggtaaaataatagattttgttgtcaataaaagtactaaaaatacagctccaatagctaatagatttacttttttcatatcagaagtaactgtatccattaaatcataggtagaaaccccttcacctgcaagataccagtcttttttataatatttttcagtaatatcacgaatatttttaactaatttaaaagtcttttcaccttcataatctgtttcaacagatattatcattcgagtataattgtctgagtttaattttgaaattgtttctgaatcaagatatgattctggtatttcaacaccgacagtatcaacataagacatgatatttgttacttgaggcaaattttttaattcattggataaatctttttgtgttgcagtactctctttaggaatcaataagacatatgtgtcattttcgccaaatatagaatctatttttttgatgtttgaacctaatttagtgtctggaccaaagatgtgtgatgaaccataataaaaatcatttgcattagaagctagatagcagggaatgattaaaataacaaaggcacataataatggaaacattgtccgaaaaacaatttttccaaaaccgttaaaagatggcataaaagaacgatgtgttgttttatcgatccatttatatgtataaagaataaatactggcataaatgtaaatactgtaattaaacttatcaaaacgcctttagctaatgctaagcctagatctggacctatttgaaatctcattaaacaaagtgctaaaaatccaattactgttgttagaccactagaaagaatagatgttgttgacatacagagggcatttaccatggcattttttacatttttttcttttttacgacattcttcaaaacgatgaatcaaaaatacggagtagtctaaggaaactgctaattgcaggatacttccggcagcatttgtaacaaatgaaatttcgccaaagataagattacttccagcattaatgataacagcaacacctaatcccaataatacaataaatggttcagcccaggaagttgttgttaaaatgagaatcaacaaaacaagaataatagcaatgataacaatttttccaatttcgctaacagtacttgttgtcgctgctacagttgaaacagcacttcccatcatagaatttttatcgccaatgatttcttggatgtcttcaactgcttgaatatttttatcttcttcaatagtgatagaaagtaaggcattattatctttataataagtttcaatagtctttgaatctattgtttctaatggctctgtaatatcaatgacatcatcaagccatgttacattactaacaccatctactgatttaatgatgtttttataatttaaggcttctggaatcgaaacattttccaacatgacacgagcattaggaattccgccatcatattcttttttcataatgtcaattgcagtagtggaagaactatctggaggaagataatcattcatatcatagtttacggtaataaattgtcgtgaaattaagcaaataataaacagaattgaaaatattattaaaattattttaggatgattaataatttggttataaatttttttcattatgtctatcctcatttcgttattgatatgtttcataaaaaaatatttttatatgcaaatagtcttttttatgtatattaaatatattaaaataaaatcctagaaacaatggacaattatcttgttagtgggtaaatagggacaaatcatattgatttgatgggtaaattataattgaaaatataggaggttgatttctaatgacgcacgatgaaatatcattacaaaccaaacaaaaactagcgacatcattaaaaaagtttatgacgttaaaaagtctaaacaaaataacagttacagatattattaaagattgtaatgttaatagaaaaacattttattatcactttgaagatatttatgatttattaaaatggattttagagcaggaagctgttgaagtagttaaaaagtttgatttaatgattgattataaagaggcaattatttttgtgatgaactatattgaaagtaatgcacatattttagcttgtgcatacgattctttaggtagagaagaaatgcgccgatttttatatcatgattttactagtattattgaaacactcatcgataatgtagaaaaagaattaggtctttgtgtaaaaaaagagtttaaatattttgtatgcaatctttatacagagtcgttagctggaaatttaatagaatggtttaaaaatccacaaaatcaatgtaaagaacaagtcgtagaatatttatcgattatttttcgttcatctttaccagaaatcttgaaaaatgcccctaaatattagttatataattatatttgtagtttgttgacaaagttggattttgtactttgtcaatttttttgctttaataattgtgtttcatttttataagatttggatatagtaataaaataattttataaaaaattttttactgccaaaatcactatttttagttaaaaatcaaactattaacattaaaaatttacgattaaagattgttttatatgttgtataaagaattagtatcctattttatgataaaaacataaattgaaaaaaaagttaatagtggtataatgtttaatagcgatattatgttaaattatgctgatttatagaggataaattgttgagggaggatcgtaatatgaaaatgagaagaaagattatggcgttattattagtgttagttatgattgtggttgttttaccactgccagttttaaatgtaaaaggggctgacaatataattaatcttaatgagttagcaccatttaaaggaagaacaaagcaggaagtagctgcaaaataccaaaatgttaaaattaatgaatactatgattatgggactaatgaggattattataaagaaaaaccatcgttagtggcaccatatgctggtggtgaattaaaagaagaagtccatcaggcaatgagtgatatggtaaattattatcgctggttagctggtgttgataaatatgaacaaagatctgttcatagtgaaaggttacaagccggagcggtaattcaaaatttatatttaaaagctgaaggaaagttaacgcataatttagctactgattggtcaaaacctgataatatggatcaatatttttggaatataggtgcatatgctaatcataatattatagcttataattatactcctcaaggagctattgagggctggtttaatgaaggatataatattgaaaataaatcttttgatactattggacaccgtaaagcccttttatcatatacaactacaggtgctgattttgggtatgctggtgatattgcatatggattaataaaatctcaaggaactactgatttaccttgtgttgcctatcccgcaccaggtgcttatccaagtaataatattgaacctaatgttacagcatggtcagtagaattaaatcttgataaattaagttataattctttgagcgatgtaactattcgggttaccaatttaacgactaatgaatcatatgattgtacaaaagcaaataacaaattaattgaatcagacaatcaaaaagggcaattagtgtttgttcagccgacagtttctacaaaaacatatgaagatccttataaagtagaaattttaggattgaaagatgagagtggaaatacgagtgtagttgaatatcaaattgatttcttcgatgtaaatactttagttccttctactgttgatcatgttagtacagattgtttaaatgtatacatgggagtaactgcaaataacccttcctttacaacaatagaatcaattttaccaaaacaagtaactataactactgatactaatcgaacagaagtaattagtgttgaatggcaatataatgaagagacaaatgagtttatggttaaaccagaatcttatatgttcccagatttaataaacgataataatcatgtcttagaaaattttgcaataaaatatgagacccaaaatactgtagataatagtcgtacccttaattatactgtaaatgaaaatggaactgttagcattgaggtaattccatattggtcaaatgctgatatattttactggtataaaatttcagataatggatcagtatcattgcttgatcaaacatcaaaagtgttaactattgaaaatgtaagtatggatgatgcggggcaatattttgcagtatataaatatagttatggctcagatgtgtatgtaactcctattaaaacattaaatgtaatatcatcaaaaacacttacaagtatagaaataacaccgcctgcaaaaactcaatattttgtaggagaagatctggttttagatggcttgaatgtaaaagcaatctatagcgataatagtagtgaagtggtcgacaattcgcaagttcaaattagcggttttgatacaaccattcctggtaaaaagacaatcacggttacttatcaaaataaaacagcaacatttgaaattgatgtaattgaaaaagaagtaactagtattaaagttacaccacctgcaaaagtgcaatatcttgaaggtcaggaattagatttaacaggtggaaagataacagttttctatagtgatggcagcagtgaaataatagatttaacaaatgaaggaattgaaattactggttatgataaaaataaaattggtagccagcaagttacagttatatataaaaatgcgtcagctacttttacagttaatgtaaaagctaaagaaattacagatatcagcatgagcagtttaccggataaagtgcaatatgttaaggggcaagatctagaattagctggtggaaaaatattagtaagatataataatggaacgagtgaagagatagatttgcttgattctcgaattacagtaactggttatcaaaaaaataaaattggtaatcagaatttaacagtgcgttatggcggaaagacaacgtcaatgacgattgaagtagttgaaaaagttgttacaagtatttttgcaacagcaccaactaaagttcaatatatcgagggtcaagaaatagatttaacaggtgcaacgataactgcaacctataacgatggaagtattcaagagggaatagctgttactaaagatatgataagtggttatgatagtgcgatttttggtaatcaaacgataacagtaacttatcaaaatcaaatttcagtatttaatgtaaatgtaaaagctaaatcggtagttggaattgaaatgcttaataatccagctaaattagaatatattgaaggacaagagttagatttaacagatggaaaaataaaagtaatttatgataatggttcatatgatgaagtaacaattaaattatcgatgataagcggctatgaaaataataaattaggaaaccaaaatattagtgtttcttatggtgagtttactactcaatttacagttaatgtaattgaaaaagttgttacaaaattagaattgatttctttacctaataaattgagttatgtaataggtcaagagttgaatgtcgaaggagcaatgttgcaggcagaatataatgatggtgaagttaaagataatattgttgtaactaatgatatgtgcagtggctttgatagttcaagtttaggaactaaaacagttaatgttaagtatgaagaagggtcaattgcatttaatgttaatgttgaagaaaagaaactggtagatttgaaaataacagcaccaaataaaactacttatattgaaggacaggaaattgatttatcaggattaaaagtacaagcagtttataatgatgatagtgaagttttacttgatttgaatgatgttgtgattacaggatatgatgctaataaaattggtaaacaattgattacagttacgtatgaaactttaaataaaagttttgaagttgaagtgataaataaaacagcagaaaaaattgaaataacttcaccgttaaaattagaatatgtaaaagggcaagaattaaatcttgatggaatgacaattacagtaacatataacaatggtgaaaaagctaatctaaatattgctgatgttggaattgttggttatgataaaaataagactggtaagcaaatagttagtgttatttatcaggataaaattgctgtatttgaagtaaatgtgattgaaaaagtagtaacagaaatttctataagtactcctgcaaaaacggaatacattcaagggcaggctcttgatttaacaggagtaacgattattgctaaatataatgatggaacaagtaatccaatcagtgttgaaaatgaaatggttagtggatatgatgctaataaggttggaaaacaaacagttgtaattacttttgaaggaaaaacagcaacatttgaagttgaagtgttagctaaagaaataactaagatggaaataacggcaccatcaaaattggaatatgttgaaggtcaggaactagatttaactggggcatcaatacttttgacatataatgatagtagttcgaaaactatttcaattactaaggatatgatcagtggttatgataatagcaagattggtaaacaagttgttaatgtaacatatcaaaatcaatctgcaacatttgaagtaaatgtaataaaaaaagcaattactaatattgaaatgaattctttaccaaataaagttaattatattgtcaatcaaacatttgatattactggggcaacacttaaagtaacttataataatgatgaaacagaaattattactgtaactaatgaaatggttacgattcctgctttatcatcatcaggaagtaaaacagttaaagttgtttatgatggctttgaaacaagttttaatattatcgttagaaataaggcattaacagcaattgaaatctttaaagcacctgatagagtagaatatattgaaggtcagcaattggatataacaggtggtaaattatcgttgatctatgatgataattctaaagaaataattgatttagattctacgatgtgtaatgttgatatgaatcaaattggtgaaaaagttgatgttgaggtatcatataatgaattaaaaacatcttattcaattaaaattgatgctaagactgttactgcaatgaaatggatcgaagaaccagatattttacaatttaaagaaggaaaaccatttatatttagtggtaaattagaattaacatataataatggtagtgtagaaattattaatgctaatagtgatgattttatcattaaaggatatgacaacagtaaagttggtcagcaagtgattgatattgtttgtaaaggaactaatgtttcagttaatcaaacatttgaaatattacctaaaacatctataggtttagtgatccaaacattaccaactaaaactgtttatgaaatgggtgaagaatttaaaatcgatggtttagtagctgcaatcgtttatgataatgatacagtagaaataattccattagaaaaattaattatttctaaaccagatatgaataaagttggaaaacaaaagatcaatctttcagatggaaaatataaaacatcatttgaaatcgaaatcatcaaaagagaaacagctcaaaatgatactcatgtagctgtaaatacaagtgatgatacgtcgattgcaattcatagtggtactttagcattaacattattgacagctgtaatttctttagtaaaaaagaaaaaagtaacagtatcataaataaaattacaatctcaaaataaatttcttgatagattgttaattaataggataaattaaaaaatgatgttagattaagaatataatgattagggtagctaatatgcgtatcgataatgattaaaggaaaattttaataatataaaaattaaagttttctaataacagtatggctagaaaatagttttaattatagaagttattatttgatacaaatactattaaaaagtagctataaaaatagaagctttacaaaacaatctaagattttgattaaaagagactatttcataatatgaggtactgtgactcatattatggaaaaagtctcttttatatttacattatgctttgatcaattaaaatattaatcatagataattagttttatgataattttaaattatagatttaatgaatatattaccaaaaatattaaaaactgtagttgataatgaatataaatatttattatctgatgaaggaatcatagataaaaatagtatgtcattatataaaaactaatgttatacagcataaattgatattttatgagtatatatctgtatgatgaaatttaagattggaaattagtttgaatacatgcaaatattatttaatatatttttttaatatatgataaatatcgattagtttttatttaaagcatttcaccagtcatttttaaatcaatataaatcatattaataagataatttttaaaagttacgaccgtttaattgaatatcaaaccattaaatggggaaatgaacaatatcattatttattatgttatagtaaaggtaagtaaaacagctaaaagaaatgatgcttctgtttattatgtaaataagttatggtaacgttaaataggtaagggaaaataaattaaagaaatgataagaaagtaatcaaatatgaatttgaagtattagaaaaatttcttttctgctttattaaaatatttgcgtctattaatgaagttagacagaaaaggaggaaattatgttaaaacatattagctgtttattcactggatgttcattgattattgctatcactcctattgatgattgtcagagaattcaatatgtatcaggacatgatatttgtcgaattgttttaagtaaattaaaaacatcagcaaaaccaagagctcgttatgaacttactggcaagtttattctagaatgtgaaccaagacattcaggtccatgtattactgaatattgggaatataagatcggatcattataattatgaaaaataataaaaatttatttatagcactttttttaatcgtttgtataattggtatgctgatagttagatattgttatgatcaagctattattaatagtacaactgcaatagttttaaatgaaattttaggttttccctgcgcagttgtgattatatatagtttaataatgcatgttaagaaaaagaaaaattaattctaacttttatttaataaataataattagtattggaaaagctcctaaatctaggagctttttagagtattttatttagattgatctttggttttagatgcgttgatgaatcattataattaaattgttttaaataattaatgacttgattagttaaataagtaggggtagaagcgcctgaacttacggcagcagcttttttattctttaacatttctaatgtaatatcattaacactttcaatcatataagtagttttattagctttattacaagcaatactagctaattttttggtattatttgaatgtggatcaccaacaataaaaacaacatcaacatcatcgttaattttagcaatggcttcttgcctgattgtagttgcctggcatgtttctttagcaataattaaattaggaatctgtgttttagcatattcacataaatcatagacatcatataaagacatggttgtttggttggtaataacatattttaaatttttgtctaacttatctaaatctgttttagtttcaattaaatgaatatgttcataattaatagatagggcaccttctgattcaggatgtccatttttaccaatataaagaatttcaaaccctttattaagatagtcttttattaaatcatgagtcttgatcacatcgggacaagttgcatcgattacgtttagatttttttcaagcgctttttttatgacattatcactagctccatgagctgtaataattacggttcctttattaacttcttctaacaattcttctcttgaggcaccttttttatcgattgttttaatccctaaattttcaagggcatcaacaatatattgattatgaacaatcattcctaatatataagtatcttcatgatgtgcctgtttttttgctgtttctattgctctgataacacctttacaatatccacgaggaacaatttgatagactttcattatatcacctcaaagttattgtatcatattttcaaactgtacgtcattatcagtagagttttttattttttcttcgttgagcggagtgatattttgttctacttcatcaaagtcaatatcattaatatgatttactgcttgaataacgcgaaaggcatttttagtattattaattattggtcggatttgatatattaatggaattatttggttgatcgtatatattgttttagtagcataatgtaatgatttttggatattagctcgggttttcattttacgattaattggatatacttgattcataggatagatttgtggattaaagttatcatagtagaaattctcatcataaaatgggttcatactatccctccttttattatagtttatgtgttttttttgtatgtgtgccagaaacaaaagataaataagtattttttttaataagtacatcaaaatagttttaaagctctcttaccaataataatttatgtgtattcttttgctttatttacccatatgttaaaatgaatatataatcaatgtctaagtaaaagtgtgaaattcaataaaaagaaaatatatgattataatgaatgaaaagatttaagaaagcagatagatttgatgtgtagtgatgtcaattatataagatagttttaaagagaagataaatttatttgctttttatttatgttatgataaaattaattgaatttctcaaagaaaaggaggaaaagatgagtacattcgaaaaatataaattacaggaattttgctatcaaacaattaatgaattaggttttattaaaccaacgccaattcaagaacaagtgattcctttaggatataaaaataatgatataatcggtatttcacaaaccggaacaggaaaaacacatgcctttttattaccgattatggatcaaatagatacaagtaaagatcatgttcaagccgtgattactgcaccgacacgtgaattagcaacgcaaatatacaataatgccaggttatttgttaaatataatcaggatattcgggtatctttaataattggtggaagtgatcgccaaaaagcggttaataaattattagtccagcctcatatcgttataggaacaccaggaagaattaaagatctatcattagatgaacaagcattaaaaataacgacagcttctatccttgtaattgacgaagcggatatgactttggaatttggttatttagaagatatcgatgctgttgcaggtaaaatgaaagatgatttgaaaatgatggttttttcagcaactattccccaaatgttaagaccgtttttaaagaaatatatgaaaacaccagtaacgattgaaatcgatgatgataaagttactactgataatgttgaacatattttaattgcgacaaaacatcaggatcgatatgatgttttaaagaaaataatgaaggctattgacccttatatatgtattatttttgcaaataagcgtgatgaagtagcaatgataacaaaaaaattacgtgaagatggtttcaaggtaggagaaattcatggtgatttagagccacgggaacgtaaacaaatgatgcgaagaattcgtaacaatgattatcaatatattgttgctactgatattgcagctagaggaatagatattgatggggtatcacacgtaattaatatggagttacctaaagaagcagatttttacattcatcgtagtggtcgtagtggaagaggtaaatatacaggtatttgttacagtatgtatgatactagtgatgaagaaaatctaagaatcttagagagaaaaggcattgtttttaaaaatatgacaattaaaaatggtcaatttgttgatctaggggaacgtttaaaaagaactaagcgccctaaacaacaaacagaactagaaaaaaaagttcaaagtattattcgtaaaccaagaaaagtaaaaccaggttataagaagaaacgtaaaagagaaattgaaaaagtagtccgtaaacaaaaacggcaaatgattcaaaacgatattaaacgtcagaaaaaagaacgtgcaaaagctgcacaaattgctaaaagaaatggagaagaatattaatgataattggaagtcatgtctcaatgtcaggtaaagaaatgctgtcaggttcagtcaaagaagctcttttgtacaatgctaatacttttatgttttacacaggagctccacaaaatacagcacgtaaaccagtagatcagttaagatttgatgaagctaaaaaattaatggaagaaaatggcattgatattaataatgttgttgttcatgcaccatatattattaatttagctaatacgatcaaaccagaaacttttgaattggctgtaaactttttaaagcaggaaattgaacgctgtaaagccttagaaatgacaagattagttttacatcctggaagtcatgtaaaagctggggcacaggcaggtttagataaaattgttgccggactaaatgaagctactaaaaattgtggcaatgttaaaattgctttagaaacgatggcaggaaaaggttctgagtgtggtcgttcatttgatgaaataaaatatattattgaacatgttgataataatgaatgtttaggagtatgtttagatacttgtcatatgcatgatgcaggttatgatttaagtaaatttgatgaaattttagcggaatttgatcaaaaaattggtttagatcgattattagttgttcacgttaatgattctaaaaatgtatgtggggctggaaaagatcgccatgaaaatattggctatggtcacattggtttcgatattttaaataagatcgttcatcatgataaattaaaagatgtccctaaaattttagaaacaccgtacatcgataaaagagcaccatataaagatgaaatagaaatgtttaaaactcaaacttttaatcctaatttaaaataattaggacaattagctaaaaaagatttaattttaaggcaagtagcaatacttgtcttttcaattatataattataaagtacttcattgtaatgactatcaactaaggcataacgattattctgaatcaaattataaattattaataattgatcttcatcaatttcgatatcctgatcataaacaagtttttcaaatgttttaaaatctaaatcaaatagattatcataattattattactcattattttgcctccataattaataatatgcataaataaaataaatagaactgtattatattaaataaaagtaagattattcagttcctttttagatgttattcggtgaattattttaattaaaataacagctatttagtcaaataaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcatttgttattcggtgaattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttatttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaacagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacatttagataagtgtaaagagatttggatactaagatatttttgataaagagttttaacataaaaatataattttttaattatcatagcggaattttaataaaatattattttttaaagtactaattcttatgacattaattacacctcctatttattatatacaatggaatttttggttttactttttagttaactatttttattaaatatttgaaataaaactgagtttaatcaggctatctagtcagtacttaaaatgagctgaaagataatgtattatttggtaaaataattatatagatgaaggggtggttatatgaattggcatgaaaaactgcagatgattattgattatgttgaaaatcatctacaacgaaaagaggaacctattgataatgatgaaatagctcggattgcaggatgctcttttggcttttttcaaaaaatattttcatatatgaatggaatcagtttttcagaatatgttcgtttacgaaaactaactttagcgggatatgacctaaagagtacaaaaacgaaaatagttgatataagttataaatatggttatgattcgccaacatcatttactaaggcgtttacacattttcatggtgtctgtcccagtaaagctagaaatttcgatattgaattaaaagtctatccaaagatgcaaatatttaaaagtcaaagatatacttggcgaattgaacaaaagagcagttttagattaataggtaaaggtgttaaagtttcatgtattgacaatgttcattatttaaagattcccgagttttggaataattgtcaaagagatggggtgttttctcgattgatttctatggatcataataaacctaaaggtttgtttggcgtatttggagcttttgatgagcggacaatggaaatagaatacgcaattatgacaatatctaatcaagaattaccgccagattttatggagattattattcctgaaactacatgggtgatttttgattgtaaaggtgcagtgccgcaggcaatacataaggggtggaaatatttaaatgaggagtggttgataaattatccctttaaacatgcaaaatgtcctgaattagaatggtatagtagcggcaattcttttgatgaaaattatttaagccaaatatggataccaattatagaggaggaataataaatggttcatttagtttattgtgataatacgggaaaaaaaggtgaaaaagttcttgataagattttgactggaaaaaagacgatgatcgttcgtggagcggcaggaagaaaaataccccatagtagagtatttgaagatgaagagctctattttatgcaaaaagggactttgcaaattacagttaaagctaaagtaaaaaaagtggaaaattatgttaaattgacagataatgaaattactaaaatactcaatgataatcaatcaaaattaaatttgacagataaacaaaaggctcgctggcataaaaaatgtctttgtttaattgagttttatgatgtagaaaaaattgctcctttagaatttgatcatcagggcaatatggatgattggttaattattgaaaaaattgaagatgttgtagtaggaacaagtattccctataattatgaaaaatcaagatttaaaaaataagtaataaaaggattgaactataagctcaatccttattaaatcattgctaaaatttctttttttaactcagctacaatatgctcttgtttaactttacggatgatttcaccttttttgatcaataaaccttcattgacacccccagcaattccaatatcagcatgttttgcttcacctgggccattaactgcacagcccatgattgctaccgtgatattagcattgatcgtatttaagaaatcttcaatttctttagcgataggaattagatcatattggattcgtccgcatgtaggacaggaaactagagtcggaacattatcaattaactgcaattcttttaataatgttttagctacttttatttcttctaatggactatcacttaaagatactcttatagtattaccgattccttgatataaaatagtaccaattcctaaactagatttaattgtcccgcctagttttgttcccgcttcagtaacgccgatatgtaaagggtatgggaaggtttcactggctaattgataagcttcgatcgtaagtaaagtattagatgattttaatgagatacaaatatcataaaaatctagactttctaaaatttcaacgtgttttttagcactatcgatcattccttgggcagttggtttaccatatttttctaaaatttctttttctaaagaaccgccattaacaccaattctaataggtatgtgtttctttttacaagcttcaactactaacttgactttatcaatagaaccaatattaccaggattgattctaattttatcaattcccgattcaattgcctgtagggctaaacggtaatcaaaatggatgtcagcaactaaaggaacattaacacgatttttgatttctttaatcgctaaggcatcatccatatttaaaacagctaaacgaactagctgacagcctgtatttgccaattcattaatttgtttaacagttgcttcaatatctttagttttagtatttgtcattgattgaataactacttcatcattaccaccaatagtaagattacctacttttatagctcttgtttcatttcttttcatgaactcacctctaaactattataacatataaaaaacgctatttataataaatagcgcaaatacttttatgatgattttttaattgcctcaaattgatttaatagattttcaaaataattaaaggcatcttcataaatttgatcatctaaaggatcaattccggctttctttaataaatcaactggagccatactaccaccagattttaagaagtttaaataatttttaacttgattttgatcaccttttaagattcgattaacaattgctagagcagcggtcattcctaatgtatacttataaacataataattgtaatagaaatgtggaacatagtaacaagaccagccaactagatcatccattacaacatcatctccataatattcttgatttagtttagcgtataaatcagtaattactttagaagataagggctcattattttcagccatagtatgcagtttatattcaaaatcagcaaacattggttgtctaaaaattaagcctacacaattctctaactgctcataaataaaataagctttttcttgatcatctttagcattattgatcatataattgatcaataatgtttcatttacagttgatgcaacttcggcaacaaaaatacgataattagcattaacagaatcttgataatgattagataaataagaatgagcgctatgtcctaattcatgaatcatagttgaaagagaattataatcaccaataaaattcattaaaataaatggattggtatcatagctgccgctagaataagctccaattcttttaccaggagttggataataatcgatccagcgctcacttctagctttattaataatatttaaatattcttgtccaaatggttttaaacattcgttgatgatttcaaaacattgatcgatcgtgtattctttttttattgatgaaactaaaggaatatttaaatcataattataaattacatctttatttaaaagctctttttttagacgattatagcgatgaaataaatgacgatatttcacattagcactgtctaaaattttaaagaataaatcactaggtacatcatcatcaaaaacactagcttctaaagcattgtcaaatttacgaacattagcgtagaaaacatcttttttcattgccccagatagtgtttgggcaaaaacattttcaaattttttgtattccttaaaaaaattagtataggcctgtttacgtacattatcatttttactttttaaaaactgatttaaagtagcgttgtttaaagttttcatttcaccgttttcttcaacatcatcatattcaaggcgcaacgcatcaaatacctggctggaagtatcagcgatactttcaactttagctaaaagttcttcttgttctttaggtaaaatatgatctttaaatgataataatgaattaattttataagtatatttttgaagttttggatctttgatatattctaaaactttatctttagattcaataatttcattatcaataaaagagatttttaccgatgaagcttctaaaacaccgatggttgaagccatcattgtctgatattcctggttattaggctcgacatcacaatttaagtgagcaaagcagtataatttattaattaatcgttccactagatcttttgttgataaaaaattatagaaactatcaatactattacatatttttcctttaaaactaactatgtcatcaattaaagatttagctttttctaaatcctgataaaagtcattatgattttgataaatggtgcttaaatcccaagtatctttaatatcaatatcttttctttccatacaattttctcctttaaaataaaaaccctatcattagatagagttcactaatttagctaatctagatttttgtctactagcatagtttttatgatgaattccttttgaaacagaagcatctaattttgatgcaacaatgttataagcttctactgctccatctttatttccagcttcaacttcagctaataattttttaattgcagtttttaatgctgatttataagaagcgttttttgctctttttacattatcatttttataacgtttgatttgttgtttcatatttgccatgatttttcacctcgctttattcttgcctttacattatatataaataattgattaaatgcaacttttttttaaattgataagacattatttagataaaaatgtattaaaatcaaagaattggtgatatttatggtaggtgatatgatgaattttaagaatatacgtagtgatttagcgactgaatcattagaacaattagaaatagggaaacattataataaagaagaatatgttaataatggtgtaaaagtagaaaaagtatcaattctccagcctcatcaaagtattaatcaaggaatcgggacatatattgaaattagttttaaaaactacatggatcaacagatcattattgatgaactggtaaataatttaaaacccttgattgataaaatcaactatcccaaaattttaatcgttggtctaggaaatcaatatttaactaatgatgcaatcggacctagaactttaagagatattcgaattacgcatttttttgatgatgaagataaactcttgaatcattattatgatattttaggaattgctccaggagtaaaagtccaaacgggaatggagacaagtgaaattgtaaaagctatagttgataaagaaaatattgatttagtaattgttgtagatgctttatgtgctaaaaattatcgtaaattagcccatgttatccaaataaatgatgtgggaattaatcctggtagtggaataggtaattatcgtcaagcaataaatgagcaaacgatgggaactaaagtcattgcaatcggaataccaacagtaatctatgccagtagccttgttagtgatgtgttaaattatactattgattattttggcgatagtttaaatcctgtaaatagattaaaggtaggaaaaagagaaagctatcaagggactttaaatgagcagcaaaaggaaatgatgttaggacagattggaaaacttaatgataatgaacttgaaatgttatttaatgaagtattagatcctattgattgtaattttgttttaagtgataaacagattgatgaacagtgtgaaataatgtctaaaataattagtaaaagtattaattctttaaggtactaaatcctacatttcgtgcatacaattagttgtatagtatagtgggtgatgaagatgagactaaaaaatacttttttgattttattgaaattagccgttatagttggtttgatcgtatatcttccaagtaaagtatcaacttctcctaatgcacaagttattaatgctattaataatactactagttctacccctgtagcagctaatccccaaactacagagtttacaattactaaagataaaaaggttcatatctacaatactcatcaaagtgaagaatatgatggatataatgttgttttaggggcgaattatttaaaggattgtttaaatagtcagggttatcagtgtgatgttgaaggtaatgattttgaaagctacaaagctgtgcataatattgcttataacaaatcttatacggtttctaagatgtatttggaacaaagtttacaaagtaatggtggatatgatttgatcattgattttcatcgggattcaatttctaaagaattgtcgacgattagttataatggtaaatcatatgctaaaattatgtttgtagtaggaaaaagcagtggcaagtttgatgctgtaaatcaattatcgcaaaaattatcagatttagcgaatgctacgattcctaaaatcagtaggggtgtttatgttaaaaactcgcactataatcaaggtacaagtgataacatggtattaattgaagttggagctcaaagtaacactaaagaagaaatccaggcaacagttgaaatcattgcaaaagcgattggagaatatttaggctgatgaaaaattttttaattgatttatgcctggtgggaatgcttttatttatgatcaatggtttgtttggtgattttagtgttaaaaaggcaatgtttgaacaaaatattgaacagtttgaagaagatataaaagaacagcgaactattacaactgattatggaactactaatgataatgatgaaaatgcattatcattagtagtaaaaaaaattagtgatggatgtattaaagtaattgaaactttagtattgattatttctaatattattagtacacttttataagaaagtggtgattaaatgaaagatgtaaaaatattatttatgggaactgcaagtttctctagacatgtattagaagaattattaaaaaataattttaatgttattggtgttgttagtcagcccgatcgttttgttggacggaaaaaggttttaacgatgccagaggtaaaagaagtagctattaaaaataatattccagtgtttcaaccgcagaaaatcaagcaggaatatcaagaaattattgatttaaaaccagatttgataattacggcagcttatggtcaaatcgtaccagaaataattttaaacacaccaaaactcggctgtattaatgtacatgcttcattgttgcctaaatatcgtggtggggcacctgttcattatgctatcattaatggtgaaaaagttactggagtaacaattatgtatatggctaaaaagatggacgcaggaaatattattagtcagttggaagttaatattgatgatgcagaaacaactggtgaattgtacgaacgcttaagtgttgcaggagcaaaattattaattgaaactttaccaagtattattgaaggaacaaatgcttctattgagcaggatgaaaatcttgttacatatgctccaacaattagccatgaacaagaaaagctggattttaataagagtgctttgcaggtttataatcaagtacgtgggatgaatccttggcctggtgcttatactacttatcaagataaggtagttaaaatttgggctggtaaggttcatcattgtaaaaatgctattgaacaccatggacatcaagaaaatggtacgatcgttaaaatatttaaagatgctattggtgtaaaaacaggggcaggcatttatttaattacggaattacagattgctggtaaaaaaagaatgtttgtaaaagattatttaaatggtaataatgtttttaaagtagatactaagtttgaatagcagcttttttcaaaaaaagctgttttttttaaagtaattctcctttttagattgtaaaagataatgaggaggaaaaaatatgattcatgaaaaaactattatcgataataataatgttcgctttagtaatgacctgttttttaaatatctgctttccagagatactttagaatctaaaaaactgagaaagtttatcgttaaatctgtcacccatcttgactgccaacaaatgatcgttaaaaatccggaaatcaatcaaaatacggtcctcgctaaaaacatcatcctcgatatctgtgcgttgatgaaaagggccgaatcattgatatcgagatgcagatggctggcaacagtaatagtgaaagtacaaggtttcagttctatggggccagactgttagtagaacagatcgatactggtgaaaaatatcatcagctaagaccagtatatcaaatcatctttatcaatgaagatgatgatcgtttgatcaaagattatgcgtttcgagatgatcagggagagctggaaaaagaaaatcttaattaccgctattttatcaagatgagacatatcgataagatcatcaaggaaaaaggaattgaaggattaaatgatctagaaagattatgttatttgtttataaaaaatgaatacactgctataatgaaggaaagagaagaagatatagtggagatggtgataaagatgtatgacaagtttagaagtaatgagccgatatggtcattagcgaatcagttagcgttagcgaagcttagaactgaatcattagagatggagcgcgaagaaaagacagccaaaaggatcgaagaaggaatcaaaaaaggcatcgagcagggtatcgaacaagggattgaacaaggtattgctcaaggaattgagcgaggtgttgaacagggtattgaaaaaggtattgagcaaacatgtattaaattgattaaaaagcaatatcatcaagactgccaggaatgggtagagagcttaacagggaagcaattagaagaaataattgaattaatttttaaagaagctgattttaaagtttttaagcaaaaaatagatatgattaaatgataaagaaaaagtttttattagctaatgtacaaacgaaattaaggaagttttaattatcggcaatgaagttaatacttccttttgtattttttaggaaacaaaaaagaattaattattgaagaagaaattttagttaatattttgctttaattaatttaaatactggaggagatatttatgcggatggtagatttaattgatttaaagaaaaataatcactctttaacaagaaaacagtatcattttataattgatggttattgtaaaggaaaaatacctgattatcagatgagtgcttttttaatgagtgtatgtttcaatggtttaacgatgtcagaaacggtaattttgacagatgaaatgattcatagtggtgagataattaatttaaaggatattgaaggaattaaagtagataagcattcaactggtggtgttggggataaaacatcattggttttaggaccaatgattgcagcatgtgatgtcaaaatagcaaaaatgtcaggaagaggtttgggacatactggcgggacattagacaaattagagtcaattcccggatttaacattcaagtatgtaaaactgattttattaagcaggttaatgaaattgggattgctattattggtcaaagtactaaaattgttcctgctgatcaaaaaatgtatgctttgcgcgatgttacagctactgttgatagcattcctttgatagcttcttcaatcatggctaaaaaaattgcttctggcagtgatgtaatattattagatgtaaaatatggtcaaggtgcttttatgaaaactaaagaagaagctataatattagcgcatacgatgatagaaataggacaacgattaggtaaagatactcgtgcaattatttctgatatgaatcagccattaggtaatgcgattggtaatgctttggaagtaatcgaagcaatcgatacattaaagggcgaaggacctcaagatctattagaattatgtttacaagctggtagtaatattttagttcaagctaaaagatgtcaaaatgaagctgaggcagtaaaattattaaaacagacgatagaaaataaaacagcattaaagaaattaagagaaatggttgactatcaaaatggtgatgttaattatatagataatcctgatttatttaaaaaagcaaagtttattattcctatcaaagctagaaaagacgggtatgttaaagagataaatgctaaagcattaggaataatttcaatgaaacttgggggaggaagattggtaaaagatgatattatagatcatagtgtaggaattgttttgaataaaaaagtaggtgataaatgtgatagaggagatgttttagcttatcttcatggaaatgatgaaattgctcaagaattaattgaagagttttatcaggcttataaaatagttgatttttttgtaaaaaagccaatactaattgatgaaattcttgtataatatagatgaatggaggttgaaaatgtataaatatttattttttgatattgatggtacgttgataggtccaagtaagcgtgttagccaaaaaatgatcgaaggaattcgtcaggcccgtaaaaaaggtcataaagcttttttatgtactggaagagcaccgatatcaatcatgaaagatgtcaaagatattggttttgatggaattatttcatcggcagggggctttattagtataaaagataaatatatatttgagaattttattaatcaatatgtattatctgaagtaatgcttttatttactaatgctagaattttatttagtttagaaacaaaagaagctttatatcagactccgggagttcaagatttttttgataaaaagaataaaaacgttgtaaaagaaaatcttgaattagcacgttttatggaagaacgaaaaaatgaggaagttagattaccaatcagtaaatttgatattttaaagactaaagtaactaaagtatgttttatttctgaagataaattagcattttatgattgtgtaaaatatttaaacgagttttttaatatagttattttttctaaagagtcagacgattttattaatggtgagattattctcaaggattgtactaaaggagatgcaataaaacgagtaatagattattttaaagctgatatgaaagatacgattgcctttggtgatagtatgaatgattatcagatgattgaaacggctggttatggcgtagtttcatatttagcacctgaaaagttaaaagcaattgctgatgatacatttgaggagcctgatcatgatggcatatatgaatgtatgaaacgacttaagttaattaaataggtgatattattttaccagtaggtttaatcttaaaacagattagaaaatcaaaaaagatttcacagaagaaaattgctgaaatcttaaacttgagtataagttctgtttatcgttttgaaaatggtggacagatcagttatgaaaattatcttaagtattgcaaatatttagggattttcccatacgtgcctataattatttgtagtaatgataaagtgttgcttttatacaataaaatcaatcaaatagttttagataaagatatatttgaaatggttttattgatgcttattcaggaattaacacaaggagtaactgaacaggttgaaaagatattccttaagttagataagaaaattagtgacgattttattaagatgatttaatgagatatttatatgagtttattttagataaaaaatattttaatctagaaataatttaccgattatttctttttttgtttaaaaaattagttaaagatcattgctataattcaatttacactgattaaataactgttatttatagaattatatttattgttaataagtttaaagtagcaaaaatagatataaactttttatagataatgaccataaagtaatatataaaaagaaatatatataacatgaatttagattacgtaaaatgacataatagtatgtgaatagaaattaattatttgttattaaggagaatattaatagtagagaaaattttcaaaaatatagcagtattaagatgtagtcaaagaatattttgttattatgtaaaataatcataaaatgtctgaaataaaaaatatttcagacattttatttaaaataaagttttaaatgttttgatcagtttagaaaaataggtagctttactagcatcattatcactatacaaatcataacttgcagtctctgtaccatcgacggtgacagtcaaagtgccaataatatctccttttttaaccggtaaaatattatctttataagttatttcagttgaatatttactatcgctgtttttagctttagtaaaagcgatatcttgtttacattttacatcaatagttatattatccattttatcaattacatatttttcaataatatcatcttttttaaaaataatctcctgtttaaaattattaaaaccataatcaagcaaattacacatttcttcatttcttgttttgggagcactttccttcattaaaaccccaattattctttgattatcacgtttcgaagtagtcactagacaatatccagcttctttagtataaccagtttttaatccatcaacaccatcatacaattttaaaagtttgtttgtattaaccagccaaaaactttgtttggtattttcacggatatagctatcataaagtgaggtgacacttaataaatcatcaccaccaatttcaatcaaatatgcagccattaaggctagatcatgggcacatgtataatgatcattatcatgtaaaccagtagcatttttaaaatgtgtattttttaaatttaattgttgagctttatcattcatcatcgaaacaaatttatcaacacttccagcaatatattcagctacagcaacactagcatcgttagcactagcaatagcaattgatttaaacatatcttttaaagacatggtttcaccttgttcaagatacacttgagagccacccatactagcagcatattttgatgtagttatctgatcatcaaaagatattttattgtctctaatggcctcaaacattaagatcatggtcattatttttgttgttgatgctggatataatttttcattagaatttttatcatataaaacttgtcttgaattagcttcaattaaaatggctgctctagcattaggggtaacatcattatctaatgcttttacattagttattggtaataaacagataattagtaaggttattagtgtttttttaatcaatttgatcgcctcaataaataatatgtccaagattgataaaaatacatcaaacaattagaaaatattagtacatgtatataaagataaaagaataatataaataaaatcatatttaagctcatttagttaaattacttctatttttgttaccattattctagttttgtcgaaagcatttattcatatttttaaaagttgtatgatagcttcgaggagatgaaataatggaaaataaaatagaatataagattttagatgataaaattactgtctatttttatggcgaactaagttgtagtaatgcagctaaatatcgcagcctattagatagtattttagataaaagtggcggcacagtatattttgattttttacatacaaattttattgatagttcaggaattggtttagtattaggacgctataaccagttaaataatgaaaaacgaaaactagttcttgcaaacttatcaaaaacatcgtataaagtatttgagttatcaggaatgtttgatttgatggaatatgtagagggggtaaaagaataatgaatcaaatggaacttagttttaatgctaaaattgaaaacgaaccctttgcaagaacaagcgttgcgtcatttatcacatctttaaaccctactattgatgaattggccgaaataaaaacgattatctctgaaggggtaagtaatgcaataattcatggatatcaaaataatgccgactgtaaagtaatcattaaggtatcgattatagaaaatcgggaaataaaaattgtgatccaagattatggtaaaggaatagagaatattgaggaagcaaaaatgcctatgtatacttcattaaaagagttagaacatgccggaatgggtctaacgattattgaagccctttgtgataatctagaaattcattcaactttaaatttaggaacaaaactaactattaaaaagcaattgaaagattccagcgttgactaaaacaaatacaattgaactaattgaaaaagcaagatgcggggatgatcatgctaaagaattagtggtaagtcaaaatctaggtttagtctggtcgattgtacatcgttttaaaaataactactatgataaagaggatttatttcaaattggctgtattggtttaatgaaagccgttaataactttgatactaactatggggttcaattttcaacttatgcagtaccaatcattatgggtgaaatcaaacgttactttagagatgatggaacgattaaagtaagtcgttctttaaaagagttgaatctaaaaattaataaagtacgcgaattattgatcaatcaaagtggacaggagcccacagttgaaatgatagcaaaatatttaaaggttgatgttcaagatgtcgttgaggcaattgattcatcatattatccaacatctttaaatgaaccgatctatgaaaaagatggatcatctatttcgatggaagaaagagttgaagataagcataataaaatgtggtttgaaaaaattgctttaaaaatggaaattgacaaactagatgaaaaagaaaaattaattttatatatgcgttatcagctcgattttaatcaagaaaaggtggctcaaagattaaatatttcacaggtgcaggtatcccgtctagaaaagaaaattatcgcaaaattacgtaatcacttgaacgaataataaaacatgttataatgtcatcaggtgataaaatgaatgaagaagtagaagtcagcggtgaaaaaccagaagttagaaaaatagtagtgagaagaaaaagagcttgggtagaatattttcaagtaattgtagttacactattaattacatatggtatattatattttgttcaaatttccagggtatatggaacttcaatgctccctacttatcatgaaggaaatatagtattagttgataaagttttttataagcatagtgagcctaaaaggaatgatattgttgtagttgattataaagatgccaatttaaaagaaacatttataattaaaagagttattggtattggtggcgatcatattgaaattaaagataatgaactttatttaaatggtaagttattggaagaagactatatcaatggcgtaatggctaatagtgaggatatgactgttgatgtccctgaaggtaaagtatttgttatgggggataatcgtaataatagtcttgattctcgaaaactaggttattttgactttgaagatgatgtaattggtaaagtgttctttacagttcctttcttttaaagatgataaaacaggcatagtgcctgtttttattatgggtagtttttaacgaaaaaatatgttattctaaaactaaggacgtgatataaatgattggttctactaaatatacaacaatactttcgccatctccaattaaaaaaaagaataaatcattgaaaattttttcctgttttataattattgtattagtaatagttgttattgctttttttacaggaggaaaagaacaaaaggttaatgaaaataataaaaaagaaatcaatgagttatttaatttattgaaagaagatgatgataaagataatatttttaaatatctaaaaatatctgaaaatcgtctggatacgaacatagaaaataatcatcaatatattgctaaagcaatagtaggagcaaaaattggaaattatattgaaaatactgaggctgttacgatcgaagtgtttaataatactgatgatttaaaattacgtgttgaatatttaaaggctcaaaacgattatttggatgaaatatatgaaaatgaaaaatatggcaatttaccaaatatggccgatttacctaataaacgtattatttatactagaaaaaatattttaatgagtgttgataatagtattagttctgatttggttctaacttacagcaatatattatataaagcggttgataaaatgaattttgaacaaaatgattttcctgcttcaaaagatcttgatgaacttgaagagtattatgatggtgaattaaatgtttggaaacaaaaatatccaaaagatagtttgcttaatggcatcagtttattagtaaacaatatgaataaacaggttgatcttgcttatgcatcaaataacaataatttagtaactaattgtttagatgagttgaaatattatgatgtaacaaaatatcaacaagaatacttgcattggaaaaaactgcttacaacagctaaagaaaatcttgataatggtttgatttctcacgatatgatggaaaaaaacaatgcatataaacaaatggtatatactgaaggagaatatattatcggggtagatattttaccaggtgaatacgtagttgtaaaaaatgatggtatcgaaaaaggccgtgtttttcttgaacatcaagaagatgtttctagtaatactattattaatgctagtggtgatgattttataggtaaaaaaatagttttaaatgggacgacaatgtaccatattgataattcagaacaaattaaatcaaaaatcacaaatacttttaaggttggaaaacatattgaagctggtgaatatgaagttacttatgattattatgttaatgtatatgttttagatgaaataaatggtgtgattgatgtatcaacggcagaaaaatatgaagttggacctgaatctaaaacaattactattaaagatggtcaatatatagtatggaattataatagtcttcgaataagtaaaaagtaggtgaaaaaatgattgaaaagaatattgttgctaaaattcatgaagatgatcctaattttaataaaacggaatttaaacagtggtgtaatcaggtattaggaaaactgcaggaagcctggtcaaaaaaagacttagaaactttaaaatattatgaaacaacaacgctttataaacttcatgaaaaacaattaaatacaatgaaagaaaacaaagttgtaaatgttgttaaagaaatggaaattattgaaacaaaaatcattgattttgaacgattgagtgattgtgaagcaataacagttcaaatgtttgtaaatttaattgattattaccaggaagaaggtaatggcattgttttatcaggcaagatcgatcaaaaagtaaatgctaattatcgaatgaagatcatacgagataaatattttttaacagaatggttaataaatcataattctgtttgtcctttttgcggggcgccgatcaaaaatattttacaaacaagatgtgaatattgtgatggtgttttaaaaacgatggatagctgttataaagtttattcattacagatataattttagataaaaactaaagccgttaatactcgatttgtgatcgtttacatataatttacgtggtcttaacgactttttttgatttatcaataaatttaattttttttgcaataagtattgtatacaatatgacttttatgttaaaatgacaaaaatcaataagtgggggaagtacttattgaataaagaaagggtggttacatgggttacaaatttaaaattacacgcgggaacgcaatcttaaatttttctgaagaatattgtcaatctcgttgtcaattaattgaaagtgaatcatttgcacgagtgttaaaagggtttatacatgtatgtaaaagaaaagaaaatactacttatacgtatttaagagaagtaaaatcagaaagtgttgatattgttgctgatttaagaacgatttttaaattattactagttatgtcagtagaagaagtattacaatcttatccacagtttgctggttattttagaaatcgtgatgaatttgttaaagtcattgaagaagtatatcttttttggagaaagctacagcgttatagtgtcgtttataatgaaagtacaagtcgtgggtatcaaaatgttcaatttgcagatgctcaggctaagtttgaagaattagttcttcaagtgtatcgtacgattgaagaaacggctttaggatatcgtcatcaagtatatcgtcaaattactgctggtgttaatgctggtttaagagtaacaaatatgcgttcttttttaccatatgagtatcgtaatttagatgatattccatttattgaaacagttattatacatccaccatttattacttattcaaaacgtaataaacgtgatggggttttcccagaaatgaagcataatccaatcgaggatttaaaatttgatcctgaacaatggttctgctatcctgctaaagttggagatttattagcatttgtatatttcaatgttgctttcatggctcaaggggttgctttatgtaacttgtttgaacttgcaagcgaagaagaatatcgtaatcgtaaaccagatattatctatgtatatggatatgaagatggtaaaatgaatcaaagcttctatcaagatgatgaaaatgatatgatggtagcattattatcagcaagtgatgaatttgattattttggatatatgaagaaaatgatgttaactttacacaatgttcgtaaaatcaatcaacatcagttacctatccacggagcaatggttaaaatgactttgcatagtggtgaggttaaaaatattgttgtcatgggtgatagtggtgctggtaaatctgaaacaattgaacaaatcaaagtatttggtgcagcatatattcgtgatttagttactgtctatgatgatatgggggtattgtcattagatcaagatggtaaagtacagtcttctggtacagaaattggagcttttgtcagacttgatgatttagatgcgggatatagttttaaagagttagaccgttcagtatttatgaatccagataaaatcaatgcgcgaatcgtaataccaattacagattataaagatgtagttgctaaacatgatgttgacttcttcttatatgctaataattatgaagaaggtggcgaatcattaagtttctttgataatgttgatgatgctttaaccgtatttagagctggtaatcgtatggctaaaggaacaactactgaatatggattagttggaagttattttgcaaatccatttggtccagtacaacgtcaggaacaaacagaacctattttagtggattattttaatcatatgtttgatcaaggaattaaagtaggacagttaagaactcgtttaggtattaaaggaaatgagcataaaggtcctcaagaagcagctattgcaattcttaaatatattactggtgaaaaagaattgaaacagttagaagatgaatagaactctgatgagttctatttttttttactttgaatatggtttgatgaggggataaaagtgtccaaatacaagttaatgttgattgttttaattttaattatttcattaataactttatccattcatcaaacaaatcaaattattttatataattatcatccgacaatagaaatatctgataaatttgatcctaaagctaatattaaaagagtcattggcggttcaatcgatgatgtaagtgtagatacaagcaagattaatttcaataaaactggtaaatatccaatcacatacacttataataatattaaaacaacaatcacgattgaattaaaagatacgatcatacctgatttagaagttcaagaactaacaattgatttaggaatgaaaataacagctgatgacttaatcaaaacccgttttgattctaagcgaacaacagttaaattcaaagaagattatcagtttgatcaaattggtgatcatgaagttgaaatcattatttgtcgcggaaataatcgtatttcaaaaaaaacaattgttcatgtgttagctaaagatacaactccaccacaaattttagggatccgtaatctgacggttttaaaagatagtgatatagatttattatcgagtgttagtgttaaagacaatcaagatgatagtccaattttaacgattgatagttcaaatcttgatatttcaaaagtaggtgattatcagataacttatcatgccaaagatcgatcattaaatactactgtagaaacatgtattgttagtgtcgttgaaaataaaacaattggtacttttgaacaaagtgatcaaaaaattgtttacttgacttttgatgatggaccatcagagaatacccaaaaagttttagatattcttgatgtttatgatgttaaagctactttttttgttaccggaaccaatgaagagtattattatttaattaaaaaagcatatgatgctggtcatactatcggcttgcacagttacattcatgaatatgaccagatctataattcttcgtcagcctattttgctgatttaaaaaaaatcgaagatcttgtttatagtcaaataggttcaattcctaagtatattcgttttcctggaggcagcagtaataatgtgtcaaaaaaatattgttataaaattatgactaaattaactaaagaaataattaaccgcggttatcagtattacgattggaatgaagatagtgaagatggttcggggcaattatcagttaatcagttaattaaaaatgcaactgcttctaatgataataatattatattattatttcatgatgctaatggtaaggaaaactctttaaaagcactaggaccagtaattcagtattatcaaaaaaagggctatgtttttaaaggtatcgatgatagctcttatgtagttcatcatagtgtaaataattagaattctaataagaattctttttatttttatacatataatgtattggtgattagatgaaagaaaaattaatcaagtatggatattatttgatgctcttaattattgcggttattgttacatatgtattgatcaactggctaattccgcttttttttagctgtttgatcgttttgattttacagccgttattgaataaggaaattgaagtcctgaaaataaaaaatgttttttttgctaaaagcataattgtgtttaattatttattatttattgctgtaattatcgccataattattttttgctgtatccaaatttatacagttttagaattactaccggattatttatttaatctatataatttacttagtcaaaataactatatcattgataccgctagatttctcgatattatttataatggttcaatgagtatcgttgaaagtatttctagtggctttattacgggtctagttaccgttattatgaaaattcctagtattttgtttgatttgatttttatgatcattacttcgctattcattttattagattatcaaagaatagataatttggttattcaaagatatcccatggtttctttagttattaatatgatcaaagatattttaagtaatctgtttaaagcatattttataatcatgatcgttacttttgttgaattatgggctggttttatgattataaaattagataactgtataatgctggcatgtattattgctatttttgattttatgccggttttaggaattgatatgatcatgattccctggatcgttatcaatgctttaacaaatcgtatgtcaatggctttaggcttattagttatatatatggtaatcgttattactaaaaatattttagaacctaaattaattgctaaaaatttaggagttagcccattagtatcattgattggaatgtatttaggaatgaaaatcttgggaataacaggattaataattgttccgacaatattaatgattattatccagatcattaaagtaaaatatgaactgaaggagtgaaaatatgcatcaaagaaaacaagaaatacaattacatttaaaagacaaaggaatgtttgaaggctggtattttagagttagtgatcggaaagtttctttagcggttattgtgggagtcagtgagacaatggcttttattcaaacgatcgatacgtatactaatgttagtcaaatgcttgaatttgatttgaatgagtttgaatatggaaatgctccattttttatcagaataaaaaataattatttttctaaagaaaaaattattttaaatctagatcagggtacaatcataataagaggaatattagaaaatgatgcttttacaccattaaaagcctcattatatgcacctactattatgggtccctttcattatttagcgaagatggaatgtaatcacgggatcattagtttatcacatcaaataaaaggtcgtttgatcattaaccagcaaaaaataaatataaatggaattggttatatggaaaaagattggggatattcatttcctaaagattacttatggttacaatcaaatgattgcaaccaatgtaaagcctcattatttttagcgatagctaatattcctattaaaattactagttttactggaattattatggttttgatgatagacgataaacaatatcgagttgctagttattatggcgcatatttaaaaagatggttgattaaaaaaggtcaatattatttaatcattaaacagtacccttacagtttttatattaaaattattcctggtaatagttatttgttgaaagcgccacaactgggaatgatgaacagtgatgtaaaagagagtttaaattctaaagttactgtgttaatatataaacatcataaacgaatcgataaattagactttattgcttgtggaacagagttatttggaggatttaatgatattaaagagcgagcggttgattcttaaaagaccggaaatagaagatgttgatgaaattttaaaaattcataatagtgaatatgtgcagcgctataatgcgatgaaactttatcgtcgcgaagatatgcttaaagatattattgatgatcgtaaaaatacttattatttacagctacctgattctaaacgcataattggggctgtttttgtaggtcaagatcaattacgatatcaagtaaatgctgtttgtctttcatattatttagataaaaattatcagggtcagggctatatgtatgaggctttaaaacttataatcaaagaattatttgagcagggaattgaagttattagtgctagagtctttgttgataatacggcttcaaaaaaactattaataaagttaggatttgttttggaaggacatttaagaagagctgttaaaggatttcaaggaatcatctatgatgatttactcttttctttacttaaggatgataacagctgatttgacagtaatagagttaattgatataatgtcatcattgcgttgattattcagcgcttttattatgaggaggtaaaaagaatgctaaaattatggatcgttggttcaaatagccaggtagggacagctttaaatgaattgattgaaccgctggatattgaggtatttaatactgataaagaagaaatagatattgccaatactaatgatattatccgctttggagaaataaatcgtcctgatgtaattattaattgcgctgcaatcacgaatcttgatgagtgtgccagtgataaagatcaggcttttagagtaaatgctttaggacctcgtaatttgtgtattgttgcacgaaaaattggggctaaagtagttcagttatctactgatgatgtttttgatgggacaaatgatcggccctataatgaatttgatcgtactaatccccaaactatttatggtcgttctaaaaaagccggtgaagactatgtaaaagaatttactcataaacattttattattcgtagtaactgggtatatggtaaaaaaggaaagaatttcgttaatgatcttttaaattatgatcaggcagttttaaatgttgctggtgatcagctaggatcacctactagtgctaaagatttagcacgagctattttatatttaattaaaacaaatgaatatggtacttatcatattacttgtaaaggtgtttgcagtcgctatgaatttgctcaatatcttaaagaaagagctgataagaaaattgaattaaaaaaagtcgaagctaaagatgttgataaaggtactgttagaccagcatatgcagttttagataattttatcttgcgcttagtaaatgaatttgaaatgccagattggaaaacatcattagatgaatatttaaaagatataaaggagggctaggatggcattagaaaaaagaaagaaaaagatgggtttaacgaccaagatctttattgctttattattaggagcaattttagggattgttttatatgctttaccagctagttttgttcgtgatgatattgtgatcgatgggattttgtatgtagttggccagggatttataaagttgatgaaaatgcttgttgtaccattagtattttgctcattagtttgtggcagtatggcaattggtgatacaaaaaaattaggatcggtaggcgttagaacgatcattttctatcttctaactacagcactagcaataaccgtagctttattagtaggaaacttgatcaatccgggaacgggattagatatgtcaacgattcaagcaaatgtaacgagtgttgatagtgtggaatcaacatcattagttgaaacgatcttaaatattattcctgataatccgattggttcattagctagtggtaatatgttacaaatcattgtatttgctttattagtaggagtgatcttagctaaattaggtgaaaagacagaagtagtaggcaatttcttcagtcaatttaatgatattatgatggaaatgacaatgatggtaatggctgttgcgccaattggggtattttgcctgattgcaaggacttttgctggaatcggatttagcgcttttttaccattaggaaaatatatgattggggtcttgttggctctggcagtgcagtgtttctttgtttatttaggtttattaaaactatttacaggtttaaatccaataaaatttatcaaaaacttttttccggttatggcatttgctttttcaacggcaacttcaaatgctacgattccattatcaattgatactttagctaaaaaaatgggagtttcaaaaagaatttcatcttttacgattcccttaggagcaacgatcaatatggatggaactgccatcatgcaaggggtcgctgttgtttttgcggctcaggcttttggaattaatctcgactttacagattatattactgtaattggaacggcaactctagcatcaattggaacagcgggcatccctagtgttggcttagtaacattaacgatggttttcaattcagtaggacttccagttgaggcgattggaatgatcatgggaattgatcgaatcttagatatgacaagaactgctgtaaatattactggtgatgctgtttgtacaacgatagttgcccaccaaaataaagctttagataaaaatgtatttattaatagtattaaatagtttttacatacatttattaaaacatcttatgacaagatgttttttatttaaataaatatagtttaaaactatgttcaactaattattataagtatttttcaatattaaaataatctagtattcttatatctaaagaaggcggctatgtctttaaaaaataaattatgggggtaaaagatgaaaacagcagtaattggatatccacgaattggattgaaacgtgaattaaaatttgcaattgaaaaatatttaaaaggacaaatagaacagagtgagttaattactaaagccaaagcattaagaaaaataaattggcttgatcaagataatcaaaaaatcgattttatttcatcaaacgatttttcattctatgataatgttttagatacagcatatttattaaatatcattcctaaacgttatcaaagtttggatcttgatcctcttgataaatactttgctatgactcgaggttatcaaggtgaagcaggtgatgtaaaagctttagcgatgaaaaaatggtttaatacaaattatcattatttagtaccagaagttgaagatgatgttcaaattgaattaaatggagctaaaatatttgatgaatatcaagaagctaaagatttgaatataaatactaaaccagtaattattggaccgtatacattaattaaattattacgttttacaggaactttaactattcaggatatcgtagatgatgttattagagtgtatgtagaaataatcaccaaatttaatgatttaaatgcacaatggtttgaatttgatgaaccagctttagtacttgatatgaatgaagcggatattggattatttaaaaatatatatactaagatcttgaaggaaaaaggagcgataaaggttttattgcaaacttattttggagatatacgagattattataatgatattatgacattagattttgatggtattggtcttgattttgttgagggtaaagaaactttgaatttaatcaaaaaatatggttttgatcaaagtaagatattatttgcaggtgttgtcaatggtaaaaatatttggaagaatgattatcaaaagacgatcactttgctagaagaaattaacgaaaatgtcaatgatattgtcatcagcacatcttgttcattattacatgtgccatatagtttggaaaacgaagaaaaattagatgataagtataaaagacatcttgctttcgcaaaagaaaaattagttgaattattccagttaaaaataatttctgaattaggaacaaagcatagttattatgttgataacgtgaatatttttaatgaagctgctaaccgtagtaatgcaagtgttcaagctcgtttagcttcattgaaagaaagtgactttattcgtcagccattgtttgatcagcgtcgtgaaattcaaaaagaaaagttaaatctgcctcttttaccaacaacgacgattggttcttttccacaaacaagtgaagttcgtgctaatcggcgggcgtatcgtaaaggggaaatagatgaaactgcatatcgcaatttcaatcatacaatgattcaaaaatggatcaaatatcaagaagaaattggtttagatgtacttgttcatggagaatttgaaagaaatgatatggttgaatattttggtgaaaatcttgatggttatttatttactgaaaatggctgggttcaatcatatgggactcgttgtgtcaaaccacctgtgatctggggcgatatttctagaaaccatcctttaacagtcgattatgctgtctacagccaaagtttgacagataaaccagtaaaaggaatgttgacagggcctgttacaatgttgaactggtcatttccaagagttgatatttctttaaaagaatcagctttacaattagctttagcaatcaaagatgaagttttagatttagaagctaagggaattaagatcatccaaatcgatgaagcagctttaagagaaaaattaccattacgtaaaagtgactggcaaagtgaatatttagattgggcaattccagcttatcgtttagttagcagtagtgttcaggctgatacacagattcatagtcatatgtgctatagtgaatttgatgatattattcaggcaattgaagatatggacagtgacgttatttcatttgaggcctctcgttctaatctaacattattagatactttaaataaagttaagttcaagagtgaggtaggcccaggggtatatgacattcattcgccaagaattcctagtgttgaagaatttgaatcagcattagaggcaatggttgaaaaaataccagtaaataaattatgggtcaatccggattgtggattaaagacacgcggggttttagagactcaaagcagtcttgaaaatatggtaacagcgactaaaaatattcgtcttaaacttcaacaaatcaaaaaataatgttaaaatagctaaaaaggaagtgaaaaaatgacattacaacaactacggtatattattactacagctcaaaaaggaacgataagcgaagcggctaaagaattatttatttcgcagccaagtttatctaatgcaatcaaagaattagaaaaagagctaggaatcgtcattttctcacgaactaataaaggtattgtaatcagtgatgaaggacttgaatttttgggttatgcacgccaagttgtggaacaggcggatttgttggaaaatagatatttacaagataaagtgacaaaaaagcgttttagtatttcgacacagcattattcttttgctgttaatgcatttgttgatctagtaaaaaaatatcgtgataatgattatgaatttatgattagagaaacgcgaactcatgaaattatcgaagatgttaaaacgttaaaaagtgagattggaatcttatatttaaacgagtttaataaaaaagtaataaataaattattaaaagaaaatgatttggtttttaataaactgtttgatgctagaccacatatttttgtaagtgatactaatcctttagctggtaaaaagattgtgacacttgaagatattgaaccgtatccttatttatcatttgagcagggacaatataattcattttattactctgaagaaattttaagtacgatgattcatcaaaagatgatcaaagtaagtgatcgagcaacattatttaatttattgattggtttggatggttatactatatgtacaggtgttattagcgaggagttaaatggtaaaaatatcattgccattccccttgatgtcgatgaagtgatcagtattggttatattgttcataaagacactattcgcagtaatttaggtcagatttttattgaagcactaaagcaaaatacccaggaattgatgtaagatgtgtttatgcacatcttttaatatgtcaatatcgttcaagtaagttttttttatttatgttatattgatgatggtgatgatgatggaagaaaaaagaattattgtttatgatgaacagttgaagatcgaagcttaccagtttataggagttatgcaaaaatttcctaatcattttcatgactattatgtaatcggttttgttgaaaaggggaaacggattttatcttgcaacaataacgagtatgttttaaaagaaggcgatatattattattaaatcctttagatagtcatagttgtgatagtgaagatggaaaagctttggattatcgttgtttaaatattagtaaagctgtaatgaaaaaaatagctaaagaaatctttacgatagcttatttgccggaatttaaagcgcctgttattttttcaagtgatttaatagataatttaagattattgcatgaaatgatcatgaaaaaagaaacggaattttttaaagaagaactattctatctattattagaacaattaatcaaagaatatgctgttttaaaaaagatagaagagttgaattcaaagaaccaatcaaaaaggtaaaacaatttttagacgataactatgaaaaacagatttcattacatgaattaagtcagatttcgggaatgaataagtatactttgattcgtaattttactcatgaaatgcaaataacaccatatcaatatctagaaacgattagaataaaccaagctaaaaaacttttagaagctggaattaatttaacagaaacagcgattcttgcaggttttagtgatcaaagtcattttacacgtttttttaaaaaattaattgggttgacaccaaaacaatatcaaaatatttttaatggtgataatgatgaataagaatttaaaagggcatttagcggctttgataactatttttatttggggaacgacttttatttcgacaaagttattattggttgattttaaaccaatagagattctttttttcagatttttgctgggactgctgcttcttattattatctatcctaaaaagatatcaggtacaactaagaagcaggaaattacttttgctttagcaggattgacgggaattacattatattatttattggaaaatattgctttgacgtattctttagcagctaatgtcggggtaattatttctatagcacctttttttacagctgttttatcatatcttgttttaaaagaggaaagattaaagcggaatttttttatcggttttgttttagcgatgattggtatttcattgattagttttaatactagttctaattttaaattgaatccattaggcgatctattagctttattggcagcattgatttgggcagtttattcgatcttaactaaaaaaatcagtgaatatggttttaatacgatccaagtaacgaggcgaatgtttatgtatggaattatttttatgctgtttacattaattccccttgattttaaattgaatttgaaaagatttgctaatcctgtctatttaggaaatatcgtctttttaggagttggggcttcagcaggatgctttgtaacctggaattttgcaattaagatacttgggacaataaagacaagtatttatatttatatcgtacctgtagttactgtaacaacgtcatttcttgttttaaatgagcgcataacgatactgtctttggtaggtacattgttaactttaatgggcttatttttatcgcaagggagtaaaaaatgatagaaaaaaagtgtgtgatgatcgttgatgaaagtttaccacttggtttaattgctaatacgacagctgttttagctacagcattagctaaactggacataaagattatcggtgaagatgtatctgatttagaaaataataggcattgtggtattgtcatgcttccaattgtaattttgaaagggaatcaaggattgattagaaatatattagaaaaagcgaataattataatgatgagattgcagttattgattttagcgatttggctcaaagctgtaaaaattatcctgaatatatttctaagatgaaagtgacaagtgaagttagattaaattattctggtatttgtttatatggtaataaaaaaagaattaataagttaacgggcgatttacctttgctgaaatagaaaaaagctaattttattttaaaaatgagctattctataagatataaaaggaggattaggatggaaaattatgaattagatgtacatacccatactttagctagcgggcatgcttattcaactattagcgaaatggtaaatgaggctaaaaataaagggttaaaattacttggaatcgttgaacatgatcaaggtattcccgggacctgcaatcccatatattttaaaaatcttggggttgttcctagaaagatcaatgatgtaaatttattgttaggaatcgaaattaatattcttgattatgatggtaagttaagtattgatgatgatttatataaatatgttgattattgtatggccggaattcatttacagtgctatcaagctggaacaatcgagcaaaatacaagagcagtaattgaaacgatcaaaaatccgcatattagtgtaatcgtacatcctgatgatggaaattgtcctcttgattatcagagagttgttttagcagccaaaaagtatcatactttattagaagttaataataatgcgttacggagttcatcaaggttaaattcacgtaataatgtaattgagatgcttaagttatgtaaaaaatatcaagttaaggttattttaggcagcgatgcgcatattcattttgatattattaattatgatcaaattgaaagtattttacaggaaattaattttccgaaagaattaattgttaattatgatataaatagttttttagaatatcttgaggataataaaaacaagtgagaatttaaattctcacttgtttaatttggataaatttatttttacatccaaatatacattttaaaccatgtcgtatacgacatggttttaatcagtgattttattactgatggtattaagataacaaaaatatttattctatcaactaacctgtttaaaactattactataatatatgttttagctttatcagaataaacatattctagaaaactaatacttgaaaaataaaatacttatatagctattcttggttttataataaatggtaaacttattagttaatatttattttaacgtttttgtattatctcattatacttttgttttaatattaaagataacttttgtttgaaaggaactataaaagtttttattatatgtgtttataatatttatctgatgaaagttttgtttattctttgtcgctgttattagtcattgatgtttctttatttctattttgttttttatatttctaaaaatattatctagacaattactttttgtaatattaaaaatatttaattctataataagtcgacaaagataaatatttggaattcttaccatttaagtatcttaattacctgtttgatcaaaaatattttatcttgattataaataataaaaagctgcatcataagttgtttttataaaaattatgtcatttgtgccaaaattatgtcattcttgccaaaaggctaaaaattataattgaaattatataaaatacaagtagatatattaaacaggtttatctaatatctcattaatctttataaactattgcaatagatatttaattcaaaaggagtataagatgaataataaaaactataaatagaatgatgtaatttaaaaataaattagtcaatatgggagtatatatcaagataccagagaatacatattttatagttatagtaatgaatatatcattatatagggcgctttcttagtggagattggttagtcatttatactgttacaagggtgctctttgattaaaaaataattgattgaatcatttaaatttagtttttaacgatatttaagagttaaaaatattaaattgatcaatactttttatttagttaatgttgaatagcgaaaattgagttatttattataaaaatgaaaaatatatagtaaaaatattttgctatagaaaggggaaagtatactagtgatgttttatgaaaaaaataagttttatttattaattataagttttctttttttatttggtgtttcaatttcaaatgtccaagcgacaaatgaagcagttattcctgattatatggctcctaataccattatagaatatattagtgatgatgagtataaaataatagaaggaggagaatttgagggaactcctaattatgataatagttttattcaaaaaactaaggaaaaagcaaatgtttctgaagataaaatcataaaaatggaaaaaccaacacctaataaaggaacaagggttttttataatgatgatggtagtttgaaggatattcaattagctggaatcaatttagacaaacgagcaagtaaatgtcctaattgtggtttaccatatatatctagaggtacaattttggaacctaatcaatggtttcagtggggtggaaaaaatggtaatgacaattttcttgaggtaaattcttctggaaaagtaagtggatatggacgttttacgaattttactgattcaaagggagaaacaggtaatattttggtaaaaggagatgttgcaacaagataccatgtggataatccacctcatggtaaaaaaataaaatgtgaagctaatggatatgttagaacgatgacaaaaagagatgttggatgtttgccgaatgcagttttagatatttggaaaacaggagttgaatactttggtaaggaatggagttcaaatgtatcaatatataatgcatcttatgaatattaaaaatatgaaaattgtaataaaaatattaataattatatgtattttaatgagcctattaggttgtcatcaagaagaaaaaaaatatctatcaattaccactactggttataatgatagtggcgaactagtgtttaatatatataaatattctttttctcaaaatgattcagaaaataaatttaaaaaaatttatgattcgcagtatcccttaggtgtatatagtcagcatcataatacagtatattatactgcagaagatgatgaaaatagcggggatcaactttattcatataatttagatactaatgaaagtaaaaggctaactgatgaattttatgcaattaatcaaattattccggtagatgataaaatatatataataggtgttttacttggtgaaagactactaaaacctaccatatatgatcttaaaacagggacaatggaaacgcttaataaaaatgatgatttaaattttgaaaatatggtttatgatgtatttaatcaaaatatttatatttcaggaagttatcaaaaagagatagataaagcattagaagaagccaatacaggaaagggaaagaaatatatttctccagatacttatatttatgctttaagtaatgatggattgactaaaatttattcaactgatcgtaaattggtatatagaatgatgcctcaaaatgatggtaatcttacttttacagagagcgagagtataccagcctgggatcccgaatattttacatacatgttaaatagacaatcaaataaaataattccaacaattaatattgatcaaattatgaatgtcactgagtttgcattttatctttcatcagataaaattgtatttttaggaactcaaagtgatgaagataatgaagaacatattcatcgtggaatatatttgtatgatgtaaaaacagataaagtggaattgatatttgaaccagcaaatgaatatataaataattttattctaatgaatgaataattatgaatgactgtagtaaagtaaaaacaagtgagaatttaaattctcacttgtttaattatattaaactgcttgattcacatcaatcaattcttttatctttaagacccagccttagtgggccaccaatataattgggggtctacgtttcatatttagtcgataatcctttttttcattgattttaagaattaatggagtaatcttaatatgaattaaattaataaaattcttttttggataaatatatttatcttcgattgtattgctttcattcattaataagcgatatgtacttaataatgcttcacttaaaactaataatgtatacaacattaatactgtaattacatacatttcattcatattatcaactcctttctcctaatcctttcctcactattataatagcacatttctcataaaaatgaaagcgttttcaataaaaaatatctgattttatcaataaattttaaaacaacttttaattgatgtagcaatcattaccatgactttgctgcttgtaaaaaataaattatttatcaagctataagttgacactttggttttattgcagtagatataaatatattgtaaaattagaatttacaggaaatatcaagatgattaagattagatatgtacaaggaaatgataaaaatttttggtatagcttggataagcatttatcggtagaagaatttgcaaaaaggtggcaaaccagcaaggttatgttttacttgtagatggaataggatcattaaaagatgattttttgggccaattcaccattttgcacaatgctctatatagatgaaaaatatcagaatttgagatatggtaaaatattgaaaaaatgatatgaaatggtattaacagctacgtcagttaatgaaaatgcatagtatttttatagaaagttaggatacgaagaatgtggcggttttgtaattgatattagaggatatgaacagccgatggaaatgtttatgataaaagaaatttgataattataatttacgaaaggagaataaaatttatgaaagtcaagttttatgatgatattgaagattctttgttaaaatttgcagtcattatttcacgctcaagagggaaatgggtgttttgtcaacataaggaaagaaaaacacttgaaattccaggtggacatagaaatgatggtgaggcgattgaagatacagcaaaaagagaactaaaagaagaaaccggagctattgattttgaaataatgcctatttgtgtatattctgttacaggaaaaaacagagtgaatgaaacgggcgaggaaacatatgggatgctttattatgcagatatcaaaacatttgcagatgatttacatagtgaaatggaaaaaataattttcactgaagtattacctgttgattggacatatccattaatacagccgttgttgattgatgaatataaacgtagagtaaatcataataaaaatataaagaaataaatgaatattagaatcattttttaattgttagaaaggataaaattaattgaaacagatctgtaagctgaaaatattcttttatgaagataaattaattattgattaggatcatactgttgcatatccaataagtttattcgttgtgtaaaatataatgttttgtaatgatcttaaatcatataaaaatgtactaaaataaaaacattagataaaataacaacaaaatattgacactaataaaaaatagttatatgatttttataaagaaaccgatgaagtggagataaaaatagatcgtgcacttacagagagcttggatggtggaaacaagcagaacgcagcctattaaatggaccacggagggcaaagtgaaaagcattagcttagtattctttgacgtgagacttacgtaagtagtcatagatgtgatagcatctactaagggcacgagtgtatcgtgaaacaaggtggcaccgcggaatattatattatccgtccttgacagaattattttctgtcgggacggttttttatttaaaaagaaggaggaaaaagcgatgtattatccaacattagatcaggtaaaagaaataataaaaaataacgaatatgatttagttcctattagtaaagaaatttatggtgatagtattacaccgattgaagttatgcgaattttaaaaaattatagtaagcactgctatatgttagagagtgtggatgatacaaaacgctggggtcgctatacttttatgggatataagccaaaaagtgaaataacttgtttaaataatgttatgaatgttgatggtaaagagtttaaagttgatcatcccggaatatatataaaagaattattaaaacgttatcgaagtcctaaaattgctggtttaccaacttttacgggtggtttagtaggttattttgcttatgattattttaaatatagtgaaccggtattgaatttaaaaagtgatgacaaagaaggatttaatgatgttgatttaatgttatttgatcaagttatttgttttgataattataaacagaagattattttgattgcaaatgccaaggtcaaagatcttgatgaaagttatcaaaaagcaactgctaagctcgatgaattacatgaattgatcataaaagggtcaaaggcaaaagttgagccgttaaaattaaagggtgaatttaatcctttatttagtcaagatgagtattgtgcgatggtaaataaagctaagaaatatattaaagaaggagatatttttcaaattgttttatcaaaccatttagaagctgaggcatctggtagtttatttgacacatatcgagttttaagaaccacaaacccttcaccttatatgttttatttttctagtgataatcaagaaattgccggagcttcaccagaaactttagtaaaacttgaagatcaaactctatatacttatcctttagcaggaactcgaccaagaggtaaagatgaacgtgaagataaacagtttgaggaaagtttattgacagatcaaaaagagctggctgaacataatatgttagtagatctaggaagaaatgatattggtaaaattgccaagtttggcagtgttacagtagaaaaatacttggaaatcttgagattttcacatgttatgcacattggttcgacagtatcgggaacgattttagataatttagaagctgttgatgctattgatgctttacttccagctggaacgttatcaggggcacccaagattcgggcttgtcaaatcattaatgaattagaaaatgatcgtcgtggtatttatggtggcgctgttggatatattgattttacgggaaatttagatacttgtattgctattcgtttggcgtataaaaagaataataaagttcatgttcgcagtggggcaggaatcgtctatgatagtgtaccggagaatgaatatcaagaatgcttaaataaagctaaagctgttgttaaggcattaaagatagctaatggaggaatagaacaatgatattattaattgataattatgatagttttgcatataacttatatcagctgattggatcgattgatgaaaaaatcaaggtgattcgtaatgatgagatgacagttgatcaaattgaaaaattaaatcctgatgtaattattatttctccaggaccaggaaaacctagtgaagctggtaatattgaagaagttatcaaatatttttatgataaaaaaccaattttaggcgtatgtttaggccatcaggctatttgtgaagcatttggcagtacaattacctatgctaaagaattgatgcatggtaagagctcaataattgaaataacagatgataagatttttaaaggtgttgaaaaaaagacaaaagttgcaagatatcattctttagcggtaaaaaaagatactttggctaaagaattaaaaattattgcattaagtgatgatgatgaagttatggctgttaaacatcaggattatccagtttatggactacagtttcatccggaatcgattttaactagtcaaggaaaattaatgatcaaaaattttttggaggtaaatgaaaatgattaaagaagcgattattaaattatcaaaaaaaattgatttaactaaagaagaagcatatgaatgtatgaatgaaattatgaatggtgaagccagtgatattcaaatgagcagttatttaacagctttaagtttgaaaggcgaaacgatcgatgaaatcacgggaagtgctgcaggaatgcgggagcactgtataaaattattaaatgatgaagatgttttagaaatcgttggaactggtggtgatggttctaattcatttaatatttcaacgacatcatcgatcgtaattgcagcaagtggcgtgaaagtagctaagcatggtaatcgggcggctagttctaaatgtggagcagctgatgttttagaaaaattaggagtaaaaattgatgtatctcctgaaaaaagtgctacaatattggacaagattaatatctgcttcttatttgctcaaaattatcatattgcaatgaaatatgtagctccagtaagacgcgaattaggaattaggacggtattcaatattttaggacctttaactaatccggccggagctagtaaacaggtaatgggagtatatgatgagacattagtcgaaccattggctaaagttttaagtaatttaggtgtcaaaagagccatggtagtatatggacaagattgtttagatgaaatttctctttctgctccaactagtgtttgtgaagtaaaagatggtaaatatactcgttatgtaattaccccagaacaatttgggtttaaacgttgtgtaaaagaagatctagttggtggagatcctgaatataatgctaagatcacgcgtgagattttaaatggtaaaaaagggcctcagcgtgatgcggtattattgaatgcgggagcagcgatttatattgcgggtcgtagtgaaacgatgcaagaaggaattgaattagcagctaaattgattgatgaagggaaagctttagctaaacttgaacagttcattgaagaaactaatagataaaggggttatgaaaatgattattgatgatattgttgaaagaactaaagaaagagtagctgaaaataaaaaaagaaattcgattgataaactagcaaaattggcttttgataaaccaatcaacaaagattatccttttgaaaaagccttacgtaaaccaggaatgtcatatattatggaggtaaaaaaggtttcaccttcaaaaggggtgattgcccaaaattttgattataaaacaattgctaaagaatatgaagatattggagcggcagctatttctgttttgacagaaccagacttttttaaaggggatgatgatttcttagcagaaattgcaaaaattgttaaaataccagtgttgagaaaagattttgtagtagatgaatatatgatctatgaagctaaattattaggtgctgatgcggtattgttgatatgtagcgttttagatgaaataactttgatgcgttgtttaaatttagctgagcgtctagggatgagcgctttagtcgaggcgcatagttcaatgcaggtaaaaaaagctttacgagtaggcgcaaaaattattggggtcaataatcgtgatttaagaaattttgaagtagatatgaaaaatagtattgaattacgttcgatggtacctgatgatattgtttttgtttctgaaagcggcattaaaacatatgatgatatcaaaattttagaggaaaacaaagttgatgcggttttagttggtgagatattgatgcgtagtcatgataaacgaaaaacttttgaaattttacaggggttaagaaaaccagatcatgaaaattaagatttgtggtttgtttagaagtgatgatattgattatgtaaatgaagctaaacctgattatgctggatttgtttttgctcaaagtaagcgacaagtaaattttgatcagaccaaacaattaaaagcaaagttagataaacaaataaaagcagtaggcgtttttgttgatagtccaattgcagatattgtcgatttagtgaatcaagaagtaattgaagtagttcagcttcatggtagtgaggataacatttatctacaacaattaaagcaatttattgatgttcccatcatcaaagcaatcaaagtagatcacgctagtgatttagatgatctaaattacgatgttgattattatttattagataataaaattagcggcagtggtgaaagttttgactggtcgttgatcaaacaattggacaaaccattttttctcgctggtggaattgacttaactaatttaagtgatgctttgaaaatcaaatgttttagtttagatgtcagcagtggagttgaaactaaaggaattaaagatcgtaacaaaattaatgaaatagtaaggagagttagaaatggcgacaggtagatatggaatacatgggggtcaatatattccagaaacattgatgaatgagatccataatgtagaaaaagcatatgagttttataaaaatgatccggaatttaatcaggaattagataaattattaaaagaatatgccggtagaccatcacttttatattatgctaaaaaaatgacagaagatttaggtggagctaaagtatatttaaaacgtgaagatttaaatcataccggatctcataaaattaataatgtattaggtcaagtgttgatggctaaaaaaatggggaaaacgagagtgattgctgaaactggagcaggacagcatggggtagcaacagcaactgcagcagctcttttagggcttgaatgtgaaatctttatggggaaagaagacactgatcggcaagctttaaatgtttatcgaatggaacttttaggagctaaagttcatagtgtgactagtggaacgatgactttaaaagatgctgttaatgagacgatgcgtgaatggacaaaacgggtcgatgatactttatatgttttaggttcagttatgggaccacatccttttcccatgatcgttagagattttcaaagtgttatctctaaagaagcaagagcccagattttagaatatgaaggaaaattaccaacggcggtcatggcttgtgtcggtggtggcagcaatgcaatgggcatgttctataattttattaatgattcttcagttcaattgattggttgtgaagcagctggtaagggtgttgatacagctttaacagcagcaacgatcaatactggaacattgggtgtatttcatgggatgaaatcatatttttgtcaagatgaatatggtcaaatagcacctgtttattcgatttcagctggtttggattatcctggaattggaccagaacatgcgcatttacatgatattggtcgagcaaaatatgtacccgtaactgatgatgaagcagtagctgcttttgaatacttagcgagaacagaaggaatcatttgtgcaatcgaaagtgctcatgctgtagctcatgcccgtaagatcgttccaacaatgaaaaaagatgatattgttattatttgtttatcaggacgtggcgataaagatgtcgcagctattgcaagatatcagggggtgaatattcatgagtagaattaatgaagcttttaaagataaaaaagcctttattggctttttaacagctggcgatccctatctggaaaaaacgatcgaatatattttagaaatggaaaaagcaggagcctctttaattgaaattggtattccttttagtgatccaattgctgaaggaccagttatccaggaagctaatattcgggcattaacaaataagatgacaactgataaagtatttgaaatcgttaaagaaatcagaaaagtttccaatataccattatgtttaatgacctatttaaaccctgtatttcattatggttatgataacttctttaaaaaatgccaggaagtgggaattgatgggataattattcctgactgtccttttgaagaaagcaaagaagttagtgatatttgttatcaatatgatgttgatttaatttcgatgattgcaccaacatctaaagaaagaacattagagattgcaaaacagtctagaggctttatttatcttgtttcttcaatgggagtaacaggtatgcgtagtaagatcgttacagatattgaaggaatcgtagaattaattaaatcagtcactgatacgcctgtagcggttgggtttggaattaataatcaagaacaggtaaaacattttgcatcgatcgctgatggtgtaatcgttggtagtgcgatagttaatatcatcaaggaaaatggtgctgatgctaataaaccattgtatgattatgtaaaatcattaacagatgttatgtaaaatatatgtagatgactagatgtcgttagacttctagtctttttttgatcttttataacaataaaaaatcaagtgacaaatttcatagagaataatagctaaaataaagatatgttttattatatgcatttgaaaaggggcgttataatgaagaaaattataaatttatttattagtttaatgatcttgacagcgtgcaggaccataaatcctgcaccaccagcagctataaaacagataaaacaaactaatatttttttagaaaaaataaatgaaaataaacaaatattagcactatattatgatccttatgatttacttgatgaaataaatgcaatgattcaaaaaaagctgcttgttgatttatatgaaataggagtcaatgattcattatcattagaaaaatatgatttgattttaattggaagtgtaattcaaaataatcaaatttcgatagaattaaaaaactttttaagtgaatatgattttaacggtaaagatgtatcattttactggtttgagggcgatgattatgaagaatatgaaaaaaacatttgtgaatatgtaaaaaatgccaatatattatccagctttgttttaaataataacgaagtttcaaagccagaattagttgattctttactagatggctggttaacttctgtttatactccagtcaatcaatgattttaatatttgatacataatcgataaatgtggtattatgacagtataaaataattaatttagggggcattatgaaagaatatcatttaattgaaccagtatataataaagaatcacaaatattgattttaggatcatttccatcagtaaaatcaagagagggtaattttttttatcatcatcctcaaaatcgtttttggaaaattttagctaatatctatgatcatgagccattagaaacaatatctcaaaaaaaacaatttttattagaaaatcatcttgccctatgggatgtaattgctagttgtgaaataaatggttctagcgacagtagtattaaaaatgtaacggttaatgatttagaaaagatcattaatcaaagcacaataacgcatatttatacaaacggtaatttagcagataagttatatcatcgatattttgatgatataattgatttgccggtgattaaactaccatcatcttcaccagctaatgccagttattcgttagaaaaattaattgatcattggcagatcgttagaaatgttgagcagaagataaaataatattataaatagaaacaaatgatcttagataatatatatttaataatagtcaaagcaaaattagtagagtttaaaatgattggagtaataatatggaaactgatcttacaaagggaaatataacaaaatcattactattattttcattaccgatgattttgggaaatctactgcaacagttatataatgtggcagatacttttatcgttggtaaatatattggttccgatgctttagcagcagtaggatcttcatttacaataatgacgtttttgacttcgattattttaggtttatgtatgggaagtggtattttattttcgatgttatatggagctaaacagatagataaaatgaaaatatctttttttgtttcttttatagctgtaggaattattactatattattagaaggaatctgtatatttgcaattcatcctattttaacttttatgaacattcctaaagatatttatcaaataacatatgattatttaattattatatttattggacttatatttacatttatttataattattttgcttcattactaagagcattaggaaattctaaaataccactattatttctaggaattgcttcaattattaatattgttttagatatcttttttattgtaaatgttaatatgaaagtatcaggggcggctctagcgacattacttgcccaaatttttagtgctttaggtattatgttatatgtcttgatttttaaaaaggaacttatccctcaaaaacaacattgtcattttgattatgaaatctttaaaaagataaaagattattcattgttgacgtgtatccagcaatcagtaatgaattttggtattttaatgattcaaggattagtaaatagttttggaataataacgatgtctgcttttgcagcagctgttaaaattgattcatttgcttatatgccagttcaggattttggtaatgcattttcaacatatattgctcaaaataaaggtgccaatttacaagatagaataaaaaaaggcttaaaagcagcaattaaagcagcagtaatcttttgtttaattatttcttttttagtttttatttttgcagataatttaatgatgatatttatcgatggatctaaagtagaaataattagggagggagttgcatatcttagaatagaaggtgcttgttatttaggaattggttgtttatttttattatatggatattatcgtggtatcggtaaaccagggatatctgttgtattgacggtagtatctttaggtactagggttttacttgcgtatttattagcaccggtatttgggacgcaggcaatttggtggtcgataccaattggctggtttttagctgatatgataggaataatatgtggtattaaaaaagaaaaatggttataaaaatatcgagagaaggattacttattttctcgatgttttattttatgatgattttaataatcaaatatataaaatgatattataaataatgtatatgttgactcatgaatgattagtgattataatataaatgtagagataataaaaagaaataaaagcaattcaacaattaatttgataggttaggagggaagatttttatatcacgattgttagttttgtttgaaatatttttaagatgaatattttattgaaatttaaagaaagtatttgtaagagataaaatattttatggaataaagaaagattataaataattaagtattggattatttcttgatacttttataatagttttaaagtaaaatataattttaggagaaatttaaatgtgaaaaaaattaaatggataattttatttgtggctggtgtatgtgttttagtagtggggttcttttttacaaactcatatgattttgtattaaaaaatcattctatccaagaattgattaatgaatcttttgcaacatcattagatgaaaacgcatctgttatttatgaagtagataccataaaaggttttgatcgagatggtgaaagatatttaatattggattatagtagtagtgatattggagatattgaagaaaattttgttaaagaaagcgattcttcatttgaaaatgaagtaagtaaaattttgcatgagattgatattgataataaatatttaccctcatttacagatgattactattcaaaagaaatagattattcaaatagagatgataagctttatttaatttattttccagaaaataaacaattatatgctttagcttattatatataatttaaagtgatgaaaagttgatactcaaagccagaataataatattgtaatcttgaattatagagaggacgagaattatatgttgaaatatatagcagcagtatttataactataatcggttttttatcattgtttgcaatattgatgattccttttatgaattatacaggagagctgttttggatattatgtagtgctttaacactatctattcaaatgtcgataatagcagtatattttaataataagagagaataaattgtatttgatattagaacatttatgacagttacagccccttaactgactaatttactcattattagataagattcaaaaagaaagaggtaactctttctttttgttttctgctcaattaaaaattaataaacattacagtttgagaagtccaagggcaccagcaagatcccttagcgatagcttcttgttttttgttttcaacaataactttaacctctttcatgatttttctcctttctgttatgaagtgacctttgtcaagtgaaaattacacattcataataaaattatttaattttatcatcaatggcatacaaaagccccaaaatactagatttatcgacagttaaccactctgttatacggagattggctactccaaggttaatggttcgtcaaataagttctaactatctatatacgtgaatcatctataatttatgatattccagatcgcgacttcttttatatcttatttatgccacaaagaaaggaccgtagataactaaacctgcttctccttttttgaggcttttctatgccattgattttgtgttctttttttctcgatttttgtcctccatttcttattttttctttaaattttcataattgtatagaaaacatctttttacatcttctatattcttcctgtttccattccccatataaatcctgctagttcccttgccactgccatgatagctacattatatggtttccctcttaataccatccttctaaatcttttttgtaatctttctactgccttatctgcatatgctacgatttcatcctcctgtcctttttgtctttttttcaacgcttttgatttctttccaactgttcctcttactaatgcctgtgtacattctaccagtgtctttctaaccatcgcattccccatcttggtgattggtgtattgctgtatttctccgcgctcgaattctctcttggaagcattcccagattcgccataaatgcctttgctgttggaaatcgctgaaaatcactcactgtgacatgtatcttcattgctgataatgtatctattcctttgaaacaggaaattttagaaaccggttccttatattcctcttcttttgaaaactcttctatcctttcatcatatttttcaatacgttcatttaaataatcatagacttttaaatattcatttaatgtttctcttacgattactggcaattctatcgtttcaagccatttgatatgggccactgtccagttgcttttcccctcatatcttaatcctcgtctcaataccaatgcactgatctgctgtttgattctctttcttgactggatgacatcttctcttagacctatatattccttgatttcattgtcatgttctgttggtacatgaacagctttgtatgaatcgtgcataagattagtggcaatattaaaggcatccatcttatcattttttacttttttatttttgactgatccatgcattgttgatggtgctaatataacacatggaatatcatggtatgcaagttcatgatataaggaaaatcctaaacatccagcttcatatcctgttaaaatatccacctcattttcttcactcattctttctttagctgacttaataaatttaagaatattctttacttcagcagcacattttgtctgtgcaataacttctcctgttgatgaattgattccacataaactgtacgtatttttatggacatccatcccaatataaattatacttttcatagtgacctcctattgtcgttatggtatcgactttcataattttgtttttttactaatcttattatgaatcgtaatccactttttgacaacttaggaggtcacttcatattatcttttttattaacaaaccaaatcaaacatcagctgatttgataatgtttacaagtaattccggattcttttccaataactcgtgataaattattaagcaatctttcacaaaatttttcactctagtacaatcatttttcttagctgttaaattaaatccattttcatcataacagttagaaaaacataatggacataattttgaagcccagcaatgtgtacaatcgtctttagactgttctatataatcatagtaataatgtttcattagttcatctttgttaaaaccggtttcaacattaccaattgatggtgaatatccaactttttcacaaactttaaattcaccatcagttgtgatataaactcttttttgtcctggtatacagcagccattcataggaattatacaatctggctcttggctaattctacgattattgatttttataattaatcttctgatagcttgaactgcataatcaaatggatcagtagtttctaaagattttctcaaaaagaaatcttttattggctctgataataatttgttagaatacgcagtattatcttcaagttcatatgttccggcttttacctttgtgttttcatagttcacttcttttggcaaccattctaaacttgtaaagaaatcataaattgcttgtaatctttcatccgtaaatggtgggcaaattacagtatagattgataaacattttttagctctttctccaaatgcatctactaaattatgtaagccctctattgtcttgtcaaatgtgccttcattgttagttgaaactctaaaattatcatggatgatcttaggaccatcgatactacaagtaatgctacaatcttctagactggcaaaaaattctgctctttccctagtcatcaaagataggttagttgttaacgcgtagctaatctttaaatccttaggtttgtgcatatttacataattgacagttttttctattaaatcaaattgaactaaaggttcaccaccataaaatcctatgattaatagtcccttagctaaaggcagcatataatctaaagctttttttatagtttctacattcatatttttggcagaaaaatttctaaaataatcactctgctcattgtaaatacaatatttacatctaaaattacagttttctgttaattcaaatacaacttgattaatcatctcggtcgaatgttcaataagttctttgtattcattataaaattggagttctttttcattagataatatttttgagttttcaactattgttttaacttcttcaatttcttcatccgaatatttaccatgaatttctataccgtttaatatatcgttcaaaatattatactgtaagggttcacatctaaatactttttcagttttagtattataaaaatatttagaattagatgttgaaaaagtaatacctaaattagataaattcattttatcactcactttcatttaaatgatatatctttaaatttaatataaaatttctttaataataaaatatctagaagttatttttaaatatagatatataattaaaaaaacaagaaattttgattatatcaaataattaatgttttattgttatctacttaatcaatatttgaaaaaaatttttattgctgaaagaatttgtataattaagtaattattcaaatgatagtcaattttaaattagatctgaagaattattttgttgtttatctatagattgtttctatttcatcttgaaaatttttaacattatttttttgttttatgatatttaaccggttattttttctgaattgcagataattaaataattataatttatctatatataaatagtattttaaagtgatatttaataaaatatacaaatcatggttttacaactataatataaaaactattcttactaatttattaagtcaattatttaatttatattattaatttttatttaataattttatatttttgatattttttatacttaaattataatcatataataattatttgtcaatatatatgatatattaataatattaattttgttaaatgtataatgaatgtaattattgtatataataactttaactaataagttaagtattatatctctaaaatcatgttatgcaaatagacaagattttgatgtagaagtgggaatttcctcattgactaaacaaaaatataagatttagggcgtagaagtatgtagtatattttaataatgagaaaagttaaaatagtttatatttatttacttaggtaaattataaaaaagccaggtgtgtgatttatacttggctttgataaaaaataaaacaaaatatgagaatagtaaagcattatttctatatctaatgtatttaatttaatctattaaatgtaacttttattatgaaatctctaatagtaatatggtctaaattagttattttttattatctttttaaattttttcttcattaatactattattatatgtgtataaaatgatataaatcaaaaaattgaattatataataatattaatattcaaatatttattatgttttaaagcgatttatgttgttattatttgaaatttatgatattttttaagtgggtgatgaaaatggcaaaggcaaatactttttttaattttgatatgcttgttttaagtatcctaaatgttaaagattgttatggatacgagatttgtaaaatgattagagagatttctcatggtgctttggatataaaagaaggaactttatatccagttgtccatacattgttaaaaaaggaatatataagcagttatgacattatagcaggaaagagaatcagagtatattataaattagaagaatcaggtaaagattatttaatgactgttagagaagaatttagaaaaaatattcagggtgtttttgatattttagagtatggtgaaaaaggtaatgtaggtgaagaataagctatacataaatgaaattaaaaatcatactcgtcaattcaaaaaaatattttttgaataacgaaattttagatttatagaccatatgggatacatgatcataaaaattgatacagacagttttattaaaaagaaaacagagtggtattaattttaattattatgtgattatgtttaaggtgtatagattgaattaacttgatgaaataaaaaatgaatcaaatttgcataaagaaatagagattattgaaaaataaaatatgtggggagaaaagaaatgaaaagttttttaaatagtttattaatctttagtcctgttgaaatttgtggattaaaatttaatattaacgaatgatatattgtgaatatttagaagatggtgcatttcatggaattccaattgtaaaaacaagtacagacagtacgaaaaataaatgttatagatatagtggtaacttagtaaaatagttgttcttacttgtgattaaaatgagaatttattataacatgtattttagttttaaaagatatgctagagatcttgttatgattgcaactggtaaaaatctaaaacaaatatatataagcaaaaataaatattcattttgtattatgttgtactaataatttataggcttttttaataatcatgtttttagaaaattgactagcttttatattttgggtaagatccaaaacaatcaaggatattggtaaatctttatatagtgataaataagagctttgtttctaataaaaatcagaaaattacatgtttataaagaagtattattcagcgtgaacaaatgataacagtactacaatacatatttgtggtataagcttattaatgatttagttattagtatgtgcgtttgtctttaaatttatatttcacaaattaattagataatctactcaaatcaaaacaattcttacaaaaaaagcataaaatcttagtttaaacaaaaatcaggtgtgaatgaaatacctgattttttgtgcttttttaatcatgtattgatcaataataattatactaaaataatttttaaatattttggtgtaattagtgctgtttttattattagtcacaattgtaaactttataaaaaaacaagtttacaattgtagctggttttgctatcctaataacgaggtgaaaaaagtgagtgttaaacacgaaattattagtatcttagaaaaaaatagaaataatgcaatttctgggcaggaactggcagatagtttaaatgtaagtcgagctgctgtttggaaggcaattaaagcattaaaagatgaaggatatcatattgaggccacacctaataaaggatatatcctgctggaaaatagcgatgttatctcaagtgaaggaattgcctgttatttagatgaaaaaattgatatatacgcttataaaagtattgattcaactaataaccaaatgaagaaattggctgttgatggtggtaatgatcgttgtgtgatcgtagctgaaaaacaaagtgccggacgcggacgatttggtcgtagtttttattctcccgcaaaaaaaggtatttatatgagtgttttgttgaaacggcaggaaatgatccaagatgcgacttttattacaattaaaaccgctttagcagtaaatcgggcaattaaaaagttatatggtataaaaacagaaatcaagtgggtcaatgatctttattatcagggcaaaaagatttgtggaatcttgacagaagcaattagtgattttgaaagtggcatgattgaagctgttattattggtattgggataaatgtttctactaaagaatttcctgatgaacttcaggataaagctacatcattaaatttagacaatgctaatcgaaatcaatttatcgcagaaattttaaagcagttatttaagataattgatgaagattttatacaggttttagttgaatataaaaacttatcatgtgttttaaataaaaatattgaatttacgattaagggacaattgtttactggaatagtaaaggatatcaatgatcatggtaatttagttgttgaatgtaatgaccaagaattaattttaagctctggtgaagtcagtattgtgggaggaaattatggaacaaaataaaattttaaccacaacgaagatagcacagtgtgcaatttttacagctttgattgcgattggggcttttattcaaatacccgtgccatacatggattattttacattacaatttttctttgttttattagcagggatcttgttaggatcaaaattaggtggtttagcggttttattgtatgttgttatcggtttactggggataccgatctttgctgccggtggtagtttagcgtatattgttagacctagttttggttatttgctagggtttattgcgggggcatattttactggtttagttattgaaaaaacatctttttcgtctttaaaaaaatatgcgttagcagtatttttagggttactagtgacctatattattggtttaggttataagtatatgattttaaattattatacaggtacagccgtttcatggaagttagtactattatcatgttttccaatcgatttaccaggtgatatatttttaagtattttagcgatgatggctggagttaggtttgaaaaggtctttaagaaggggagaagataatgttggaaaagattttaaaaggtgttttagctggtcgtgaaattagtaagtctgatgccattttactagttgatgctgatatagtttggttaaagcaggctgctgatttgattcgtgaacatttttgtggtaacaaatttgatttatgttcaattattaatggtaaaagtggacgctgtagtgaaaattgtaaatattgtgcccaatcgattcactatcacacgaatgttgaagtttatgatctgcttaatgaagcaacgattaaagatatggctttacataatgaaaataaaggcgtgaaacgtttttcaatcgttacttcaggccggcgtttaaatgatcaagaatttttagacgtgatcaaaatatatcaaagtcttcatgatacgatagagatatctttgtgtgcctcatttggtctattgaatttggaacaattaacaaaattaaaagcagcgggagtaaaaagatatcataataatttagaaacttctcgtaactattttcccaatatttgtacaactcatagttatcaacagaagatcgaaactataaaagcggcgcaagaggccggattagaagtgtgcagtgggggaattatggggatgaatgaatcatggcaggatcgcatcgatttagcttttgaattgaaggaattaggggtaaagtcgattcccatcaatattttaaatcctattcctgggactcctttagaacatctttatcctttatcaaaagaagaagttgaacgcatttttgcaatttttagatttattcttcctgatgccgcaattagaatggctgggggcagaggtttgttagaggatcaggggctaagtgtttttaaaagtggtgctaatgctgcaattactggagatatgcttacaactcaggggattacgatcgatgaagatcaaagaatcattaaagaattaggctttgaggtagtcaaattatgatcaagggattatttataacggggacagctactgatattggtaagacttatgtgacatctagaatcatcaaagaattaaaacaacaatatcatgtaggctactataaagcagctttaagcggggctgagatagttgatggtataatgattcctggtgataaagagaatgtatctaaatatgccaatttaaaagaaacagattgtaaagtatcttatctttataaagatgcttatgctccgcatttagcggctaaaaaaacaaatgatcctgttgaattgactgtagtagaaaaagacctgcatgatttatcaaaaaatcatgacatagtagttattgaaggtagtggtggtatcatttgtccattacgtgatgatgataaacaaattatgttgaccgatgtaatgaaattagccggatatcctttgattatcgtcacttcatcaggtcttggaagtatcaatagtgcggttttaactgctttatatgcgaaaagtcaaggtttagaaatattaggttttataatgaattattttgaagaagataatttgcttcatcgcgataatcttaaaatgatagagaaattaagtggctgtaaagtattaggatatcttataaaaaatggtgaaaggattagaaaagtataataaatctgtgaaaatttataagtaatgacttttttggtgattcaaaagagtcttttttatgttaatataaaaagggtgaaagtgtgaaaaataattgaacccaatcgtgagtaaaaacacaaaaaaagacgaacttaaaaacaagttcagttttatttagaaaaaacagaatattatttaggaatatcttgaattgttgatacatcaaatccctgtgattttagaaaatcaagtgctgtctcaactgtataattgttcttttctttttgtggctttggattcttaaatgattcatagtctgaaggattgaacttttctccagtaagaatcatatgataaatactgacaagcatcatccttgcaatagctatgattgctttcttgtgtcctcttcttttcttgatttttgtatatttttgaccaaaataactgtttttgtttttgatagctgccaatgcacattgtactaatactggtttaagatattgtccagctttgttgatacgaactgatttcttctttcctgcactttcattattggcaggagaaagtccagcccagcagcatagttgcttatctgtttcaaattgagtcatatcaacgccaatttcagaaatgataagaatggcagacataagctgtattccatctatttctgtaatatgtaaaaaatcatcaaagtatctggaagcacgtttgatgatttctacttcaacagcttcaatatgttgattaagttcattcatatgtgattgaatttctgccattttaaatctttgatctggctcaatttttgaacttttaagagattcaactattttatctttgtttttgcacttaccatgaataagttttgtgattttatcttcatcaataacttcagtagatagaacttcattcatgacggcctgggctgtttttccaaaagtatcagaaacaacagaagccaaaccaatattggaaacagtcatggagttctgataacggttacgttcactagttctcatacagatgagcttaaaacgataacgagagagatcccttaattcacgaatatccttaggcgggataaaagaagatttgagaagatcatgcttgaaaagatcacaaatccatttggaatctttcttgtctgttttcttgcccttgatagctttgacatatttaggatggacaagaacaatattcattttagcttcagtctcaaggacattaaagacagggaaccaatacttaccagtggattccatgcagacatcaaaacattcgtgttcaataagccagtttttaagattatagaggtcaaagttaagagaagagaaatctttctgaatatattcagtgacatgagttttcttgtcagtgataccaatggtagcgacgataaggttcttgtgaacatcaagaccagcacaattaaaacggtggattttaagcataaaaaaactcctttcaaaaaaggagaagtggcattgactgtcagtctgcaaaatatcactatagttgataaaaacaatcttaagtgtccaggctctaagtcctacttgtttgtgcttgaaagactgacggcgacttataattattcaggatattctatatagagtagaattgcctactctcctccacgtgctctgtagtataccacctctcttataggatactacaaaaacgattggatgagaattatttttaataaaatgtttgtgtctgaccgacgaaggcggacggaaatggagggaattatgaaaacgatgacagaatatgtaacaagcagattattagatgaaaaatatgaagtggcaatcgattttacgatgggaaatggtaatgatacattaactttgagtaagatagctaaaaaagtatatagttttgatattcaggaggctgcattgatcaatacaagaaaattgatcaatgatattgataatgtagaacttattttagatagtcatgaaaattttgataattatcttcagagttttgatatgggagtttttaatttaggctatttaccgcaagggaaccatcaaattactactaaagtatcaacttctttgatagctattgataaagctgttagatgtttaaataaaaagggacatctttttattgtggtttatattggacatccagagggggaaaaagaaagtttaaaaattgatgaatatgttagtagtttagatcatatgatttataatgtagcgttgtttaaaatgatgaataaagcaaaggcaccatatgtaattgagattgagaaaaggtagttaaagtttatcattaataatgcaataattatgaaacaatgttataataaaagtaacagaaggaggaaagcaatatggtaaaaagaattaatgttaccgtgactgatcccgttggtctttatgctactcccgcaaccgaactggttgatcgagtgaaggcttttaacagcgatattaaattagtttatgcttctaagacggtgaatatgaaatcattgatgggggtcttatctttaggaattccaactaaagcaaaaattgaaattattgctgatggtgaagatgaagaggcagctattgataaggtgactaaattaatgaaagaattaggcattagtgaataaaactgtcgaataattgggactttgtcccttttattttgcctattatttgataatatggtatagtaaaggcgaatttaaaaaaaggggaatataaaatggaaaattttttaaaattaatctttgcttttggagtaggattcgtaatagttttaatcgctatgcctaaagtaatcccgtttctacataagatgaaatttggtcaagttgaacgtgaagaaggacctgcgtcccataaagctaaaaacggaacaccgactatgggtggtattgtttttgttttagcagctattttagggacattaattagtacattgatttttgatattaataatatctttaatccagaattgattttaacaacaattgttttagtgggttatagtttgattggactgatcgatgatgctttgatcattgttaaacacagcaataaaggattaccaccattagcgaaactattaggacaaattgctttagcagttatttgttatttttacgcaatgaattttattccaggatttacatcagtagtaactattccattaatagatgtaagtattgattttggatatctatacccatttttaattttaattatgtttgcgggtgaaagtaatggtgttaatttatctgatggtttagatggtttggctacagggctttcgatggtggcgattgcgccatttatcatctttgcaattatgaccaaagattatacgcttgcaagttatgcaacagcaatggtaggagctttacttggatttatgatgtttaactaccatcctgcaagaatctttatgggtgatgttggctctcttggtttaggtggttttttagcggtattagcgatccttactaagcaggaattattattgatcttagttggtggtgttttcttgatggaaactttatctgtaatcattcaggtaacttcttttaaactacgtggaaaaagagtatttaaaatggcaccgatccatcatcattttgaaatgttaggctggtcagaacagcaggtaacgatctcattttggttcattggatttatttgtggaatattatcaatagtaattggagtgttataagatgttgacaggaaaaaaagtattagtgatcggtcttgctaaaagtggtagggcagcaattaagttattaaataaactaaatgcaacgattacagtaaatgagtttaaagaagctaaagatattcctgattatcagcattatgttgatatgggaattgaaatgataacgggatcacatcccgatgaattatttgaacgtgattttgattttgtaattaaaaatccgggaattaattatcataaaccatttatcctaagactaaaggaaagaaagatcccagtttatacagaaattgaattagcttttcaagtagctaaaaaacaaaattatattggagtaacaggaactaatggtaagacaacgacagttactttaattgataaaatcttaaaagggcagtatgataatgttcatttagctggtaatgtgggaacgcctttatgtgatattgttttagaacataatttattggaagaagaaaatcattatattgtcattgaaatgagtaattttcaattattagatattgatacttttaaaccatatgtttcaacgattattaatttaacaccagatcatttagattatatggcttcacttgatgaatactatgcttcaaaaacaaatatttataaaaatactgatcaaaatgactattttgttgttaacctagatgactctgtcttatcagaatatttaaaaaaatatccagttccatgtaaacaaattacaatgtcattaactgataaagctgattgtatgatcaaagataatgcaatttattatcaaaatgaatttattatcgatcttagtgatattaaaatagtaggtaatcataatatccaaaatattatgattgcaatttgtatcgcaaaaaaatgtggtgtagctaacgaagttattaatcaagaaatcgcttcatttattggtgttgaacaccgcattgaatttgtaaaagaaataaacggaattaaaatatataatgattccaaagctacaaatactgatgctagtattattgctttaaaagcttttgatcagccagttattttattaatgggtggtttcgataaaggtttagatcttcaagagatggcgacttacagtaataaaattaaacgtttagttacttttggtgctgctggtaaacgatttaaagatgatatgaagattgaaaatagtatttgtgtaaaaaatcttgaagaagcagttttagaggcaattaatcatgctcagccaggtgatattgttttattatcaccatcaacaagcagttttgatgaatttactggttatgaacagcgtggtagagtatttaaggatattgttaataaggtataagatgatcctgtaacaaaggttacaggattttatttttttttgttttaaattatagaattatgctgatgataattgtataatttaaatggagggataaaggaaatgaaaaaaatttataattggatcttaaataataaatttaagacatgtattttagttgttttattagtggggataattggacaaggtaatggacagtctgaactggagttaaaaagagacgtaattgatcttgaatatggtgaaagattagatgatttaaaatcgtatgttaaagtagatgatttagatgatctttcgtatagttgtgatacaattgataaaaatgatcgttatcctgaagttggtaaacatgtaataacttataaatatcatggaataactaaagaattagaaatagatgtaaaagatactaccgcaccaaaactgaccaaattaaatgatgttagtattgttgaatacgatagtgtaaattatgaaaattatattgatgtagatgaattatctgattatcaagttgatattgatgatagtggggtaaattattcatcagctggtacatataatgcaaatataaaaataacagataaatatggtaatgcctcagatcttacccttccagttacaattaataaattggaattggaaatttcagccagttcattaaatttagaggctaaccaaagcaataaaataaatataaaaacaaatagcaatgtaccagtacaatattcttcaagtaatgaatctgtagcaagtgtcgataatgatggaaatataaaagctttaaaggccggtaatacgacaataactgctaaaatcaatgaaagatcggtgatttgtgatgttactgttaaagacaaacaagaatctaaagcggcacctgttaaagatgataatatctcatacacagtctatattactaaaacaggagattgttatcatagtagtaattgtggctatctatctagaagtaaaatttcgatatctaaagcagcggcagtttcacaaggctatcgtccttgcagtagatgtaatccataaaatataaaaaaggaaagtgatataatggatatttgggaaaaattatatatcaaagcaaaagaacaatatcatcctgaagaagtgtccccttttatatatgcacaccatgttgtttgcgctttagaaagtgataatggtgaaatttatactggtttttgtattgaaagctgcggtggtgttcttgatctatgtgctgaaagaacagcagcattgaacatgtatgtaaatagcggacaaacgatcgttaaaagattaattgcatttagagataaagctccttttgatgaaggtagtggcatgccctgcggtgcctgcagagaattttttatgcaattaaatattaagaataaagatatggaaatcatggttgattatgataaaagaaaaacagttaaattaaaagagctgttaccagactggtggggaagttatcgctataaaaataatgaggctgatcagtaaataattatatatgttacaacttaataaatataatggcagatgtattgaaatgcagtatcaatatcattaagatctatatccaaatcatatttaatatcaacataggatgtattgaaatactttttctacaatgccaacatgatctgggcagccagtttaatagcaacataagttggtcagctcattagacagcacaaaaaattgtgctgtttttttgatttatatttgagggttttgatatgtatatgaatgatgatacatataaaatataatgaaatcaatatgagaaaaaattttttatctatgaaaaaagtataataaataggctaaaaataaatggaaataatatttagaaaataaagattatcatatgttggtgattaattgatactaactgttttataggtgatgtttgtgataatgtactatgaatatgatcttaattataaatagaatatttaaagagaataagtattaaaataaatgtataattaaaggatataaatttaaatatggatactttttttaaatactgctttgaaacattgtttagttttagaaacggttgtcaatatatttaaaatcttacatcattgttttatagtaatgatactaaagtaataagagttagaaaatttaaatagtttaagtaagcataaataaaatatgtaaaaaagtataaagtaatactaagtacagaaataaattcttgccaaatcaagaagtaaaataaatccaaatccagaagtaaaacattgccaaacacggaagttgatcctatgttaagatttcggactaactaaatgtaagaaatttagctggtttcctctcatattcattcggtgataaacactcacaatgtgagtggattcttactgtatttatagaatccttctaaatatttaaataccagctgatatgcccgattaccataaaaaatatatttgtatgaatgaagaagaaattaaaagataatcctaaaaatacaaacaaagagtaactgctactgacgattatattaatatgatatataaaatacttttagataaaataaaaccagaaatcattttagttatgtcataaaaaaggatatcaaggtacatggaaggcattggataatatttattaaaaaataattttagcgttccttatttcaatgggatggtatattgaatatagatatgctgaagatattactgctataaaaagaaatcaaatattaaaatacataacagccaaagacaaaaaaagaataaacgaaactgttgaaaaatcattaaagaaaaatatctagtcaaaaaagataaaagaaatatatacttcattttactacacgttcatggaaacagatactaatcgattagatatgtttattgatagttataaagaatcagtattaaaaggtactagaataaaaatgtcttggataaaagcttctttcatttattaaaatcattagtcatatacttatactggaggtaagaatatgaaaagtaaaagagtagtcatctcggtactgataattgtagtaattggcttaatgatggtctatagcgcttctaatatttgggctggctataaattcaatgattcattgtattacattaaacgacagggaatctttgcaataattggtataatcgcaatgtttgttttttctaagattgattatcatatttatcaaaagaatgctaataagcttttaattggttcttttattttaatgattttagtcttgattcctggaattggagcagtaagagggggttcaagaagctggtttaatttaggaataatttctttacaaccttctgaattatttaagattgctttaattatttatagtgctaattttattagtaatcattatcatgaattgaaaaaattaaaagccagtttaaaattattgttgatattaggcttaggatttggtttgattatgttacagcctgactttggcagcggggtagttatggcttgttcaattattgtgatgttgatcgttagtccctttccttttaaatattttattatgttaggaatcgttggtgtagttggaatcattttgatgattgcttcggctccttatcgattagctcgtatcgtagcattcttaaatccttttgctgatcccttaggaagcggttttcaaattattcaatcattatatgccatcgcccctgggggaatactaggagtggggtttaataatagtgtgcaaaaacatttttatttaccagaaccccagacagattttatttttgcaatttttttagaagaatttggcttgattgggggaatcttattagtgagtctttatggttacctgtttgtaactgtgttcaatcaggcaatcaaggtaaaagacctgtttggaagttttttaatgattggaattattgcaatgattggaattcagactttaattaatcttggagttgtggtaggattatttccggtaacaggtgttacactcccgttaatgtcatatgggggatcgtcgttgacgattacgcttattgctgtaggaattgttttaaatatttcaaaatcgatgtattaatgatatactattgcatagaggtgagaagatgaaagtgattgttggagctggtggaacaggcggacatttgtatcctgctttggcactagttgattatataaaagaaaaagaaccagatagcgaatttttatttgtgggaacaaaagatcgtttagaatcagttgtcgttccgcaacaaggatataattatattggcttaaatgtacgcgggttagtaggtaacccgatcaaaaagggaattgccgcagctatttttgtaaaatctatttttacggctaaaaaaatagtaaagaaattcgatcctgatattgttattggctttggcggttatcctagtgctagtgttgttgaggctgctagtagattgggttataaaacaatgatccatgaacaaaattcgatcgtcggcttaactaataagattttaattaaacatgttgataagatcgtttgttgttatgatctagcttataaatcttttcctaaagataaaacttataaattaggtaatccaagagcgagtgtcattgcttcaattaaacctaaagatattttccaaaaatatgatctagataaaaacaaaccattagtaacgatcgtaatgggatctttgggttcaaaatcagttaacgaaaagatgctagaatcattgcatagttttgaaaaaaaagattatcaagtactatatgttacaggtaaatccaattttgaagaaatgactgctaagctaggaaagctaaaaccaaatattaagctggttccttatatagatgacatgccttctgttttaaagaattcgaccctagtcgtatcaagggcaggtgcttcaacgattgcagaaattacttcaattggaataccggcgattttaattccaagtccttatgtcgctgctaatcatcaagaatataatgctcgtgaattggcagatcgtaatgcggcgatgatgattcttgaaaatgatttgaatagtaaggattttgtagaaaaagtagatcggattttaaatgatcagatagttcaagaaagtatgcagaaaaatgctaaagcattaggaaaacctaatgctcttgatgatatatataaattaataagaaaaatgttaggagcttaaaatgaagttttcacaaataaaagatgatttggttgatttagatgttggaaagataattgaggatgaaccactttataaacatactacttataaagtaggcggaccggcaagaatttatttagcagttaaagatgttgaaagtttagtaaagacgattaaatactgtcgtaaacatcgtatcaaatatatgataattggacggggatctaatttattgttttctgataaggaatatgaagggataattatttctttaaatgaaaattttaataaagttaagataaatggttcaattattaaagctcaggcaggggtgtcgatgatttctctagcttatcaggcagctaaaattggacttagcggttttgaatttatgggcggaattcctggttctattggaggcggtatttttatgaatgccggtgcttataaatatgatattgctagtgttgtaaaatcagtgacacttttaaatgaaaaaagtgaagtagtaacctataataaagaacaaatgaaattttcttatcgtcattctatttgtcaagataatcacaaattaattatccttgaggctgaatttgaattagcggctaaagatccaaatgagatcaaagctgttttagacaaacgaaaagaacgaagaatgacaacccagccttggaatatgccaagtgctggcagtgtttttagaaatcctgaagataaggcggcttggcaatatattgacgaatgtggattaagaggttatgaaattggtggtgctcaagtatcacctaaacattctaattttattgttaacaacggttatgctagtgctaaagatatttatgatctaattatgctggtacagcaaaaagtacatgaaaagtttaatgttgaattaaaacgtgaggttggtttgattaattgggagtaaagtatggcaagaaagcagcagacaatttataatgactatgatcgtaatcaagttaaagcaattttaaaaaagagaaaagtaaaacgtagaaaaagaagattaaaaatattattgataattttaattattattttgattattgccttttttatgagtgattatagccgtttaaaatcgattactgttagtggtaataatcgggtagaacgtcaagaaattatcgatgctgccaaaattaatctgcatcaggattatactttttttacaaatactgatgagatcgtttcaagaataaaagaagttcctttagtaaaaagtgctcgtgtttctaaaaatttatttggtgatgttacgatcaagatagtagaagcagatccgattgcccaatgtacgatcgataatgttttatatgttgttgatgaaacggggcggatcataaaagatgaagctggtaaatatgtaagttatgtccagcgatgtccgcgcttgaataattttgattatgaacacttagaggaatttagtaaagaatttatcaaactgccttcacaagttatcaatcagatttcagatataaattatgcaccgttatcagcagatgaaacccgctgtgaatttattatggatgatgctaaaatattatatttacgttatgatgatatggctgagcagttaaaaggaaataattatgctttattgatggaaaaatacccagatgataaatattatgattttttaggaaaatatgtgtatcgcagtaagtaatttttttatttatgataattaaaggagtttaaaaatagttgtttttatgctagaattgtgtatatattaagaaaaggagatacgtgatgaaagatatttacgctgttttagacattggtagcgcaacattaaagtttcttgttgccgaaataagtaacattaatgtaaatgtattatttgtcaaaacaattcctagtcatggcgtgaaaaaaggaattattgaagatgatcgtatcttaacaagagatatacgaaaagtgattgatgaagcagaggcttttttggaaactaagattacaagcgttgctttaacgatcccaacgataaaagctaaattatatcaaagtgatagtagtatcagtctttcagaggctggttctaagattacaagtgatgatattgttagagtattgcgtttatcatctaagtttaaacgctctaaagatgaagaagtagtatcgatcattcccgttagatatcatagtgataagggagcgacgatcgaagctccaattggagaagtatcgagaaatcttattgtcgattctttagttattacaactagtaaagaattgctttatccatacattacggtagtagaaaaatgtggaattgaagtacttgatattactattaatgcttttgcctgtgctaaagaggcctttgatgcagtgtatcttcaagaaggagcgatcttgattgatatgggttataagacttcgacagtatcattttataaagatggatatttacaatacttgacagtatgtcaggttggagggtatgatttcactagaaatattgcccaaaatatgcaaatttcgatgaatcaggcagaagcttataaaatcaagtatggctcattagatatcactaagggccaaaatgatattattcatactactgttattgatggaaaaaaacatgattatacgcaacaggatctggcagatttattaaatgagactgcatatgaagtaatgaataaaattaaagaaaaaattgctgtgatcgatgatggtggtaaatatgaaaccctaattgtcgggggtggcggtgagttagaaatgcttgatacgattgctagcgaagtgctagggtgtccagttagaatttatcgtccagaaacaattggggctcgtgacatgtcattagtggcagcaattggaatgatttattatttgatggaaagaaaacaaattattggtgaatatacaccatcactggttttaccagatattacaagtacgatgtcaataaggtttaagggtctaacaaaaacagcacctaaaaatcaaaatggcaaagtatcaaagttattagattcgttttttagtgaagattaatataaaaagagaggaaacaagttatcatgagtgaagaattaggatttgaacaagtagcacgaattaaagtaattggtgttggtggcgggggtaacaacgctgtaaatcgaatggttgaagaaggggtagaaggagttgaattctatgtcgctaatactgatttacaagtattgaaacgttcaccagttaaaaataaaattgaattaggtcgtgatttgactaaaggattaggagctggtggagaaccagaaatcggtaaaaaggcagctcttgaatcagaggctgatattcgtcaagttcttgaaggtgctgatatggtgttcatcgctgctggtatgggtggtggaacgggaactggtgctgctcctgtttttgctaaaattgctcgtgaattaggggcgttgacagtaggggtaatcactaaaccgtttacttttgaggggatgaaaagaaagaaacaggcaattgccggaattgaagagttgcgtgctaatgtcgattcaattattacagtatcaaatgaccgtttgttacagttgattggtggtcgtccaatgcaggaagcttttagagaggctgacaatgttttacgtcaaggggttcagacgattactgacttaattgcaattccagcgtttatcaatcttgactttgctgatgtttcagcagttatgaaaaatcgtggcaatgctttgattggtattgggatggcttctggtgatgataaagctaaagaagcagctaagcgggctatttcttcacctttattagaagtatctgtggctggagctaaagatgcgatcatcaatgtaacagggggaccaaatatttcattatttgatgctaatattgccttagaaacaatttctcaagaagttggagatgacattaatacatatttaggtattgcaattaatgacaatttagatgatgatattatcgttactgtaattgcaactggttttgaagaagaaaaagaggatgaatttgagcaacgtgccaatatgttaaaatcacgcagtagtgaggatgttgttccattatctgcacgttttgatatggatgatgatgacgatgatggagactttccaccagcgtttatcaaaaatagaagaatttaaataagctaacatcgttagcttattttcttaaaaagggggatataaaatgaaaaagattggttttatcggtatgggtaatatggctagtgcgattgctgggggtattattaaaagtggttttattgagggccaaaatgtttatgcttttgatattgatcaaacaaaattattgaaaatgaatgaagaatatcaaattcaatgttgcaatagtgaaagtgaattggttgacaaggtagatttagtagttatggctgttaaacctaatatcgttgaaggagttattgctaaaataaaaaataatttggtaaataaagctgttatttcaatcgttgcgggatataataatgataaatataatgaattattgttaccagcaacacgtcatttaacgatcatgcccaatacaccagccttagtcttaaatggaatgaccttatttgaaaaagaaaattcactgacaaaagaagaattagagtttgctgaagcgatgttttcgagtattggtgaagtagtgatattgccagggtatcaaatgaaagctgggggaagtatcagcggctgtggaccagcatttgtatatatgtttattgaagcaatggcagatggtggtgtaagcttgggattaccacgtgatgttgcttataaacttgccagtcagactttgattggttctggaatgatgcaaaaagagacgggacttcatccaggggttttaaaagatcaagtttgttcaccaggcgggattacgatcaaaggtgtggaaacattagaagaaaatggttttagaaatgctgtctttaaagcgataaaagaatcgaattagtatcctatttatttaggatactttttcttttactgacatatttttaaacttagaagcgctatgatatctaaggggtgaagagatggaggtatatatagagtttacttatataagtaattttttgattgttttagcagcattagaaatgatgggaatattacttagtaaagagatgacttatttagaggtgttgaaacaaagttttttattaagtttagttgttttattattatatgttgataaatataattggcttattttggttgtttggttagtaattttttattgtttgtttcataaacagatgtttttatattatcccagctttatttttatttatttttcaattttgttttttgctagttctcttatccctgaagcatttatttataatggcattttgatcacaccattaaaatcaagtggaatgatgttatttataattagcttattagttgttttgatgcaggtgatgtttattatttatttgcgtcgaaaagtaagaattaatagttatttatatccaattgagttaagttatcaaggccagaaatatttatttgatggttttttggatagtggaaatgaagtttattatgaaggttttccactgattttgataaaaacggggataatagaacagtatgagatgattgatattttagaactgaatgatttaagaagtgatttgattgaaataattaaagttgaacagttagtcatcaataatcaagtcttagaagatgtttatgcaggaattattactgggattcattatgattgtttattaaataaggcattaatgggaggagttttgtagtgataaaatttattttaaaattattaaataaaactaagtatctttattatatcggaagacatgatattttaccgccaccgcttaaaaacggagaagagaaagaagctttggatagattgtctaaaggtgatagtgaagctcgtgatttgttgattgaacataatttgcgtttagtagtttatgttgctaaaagatatgatactagtcaaaatggtggaatcgaagatttgatcagtattggtacgattggtttggtgaaagcaatcaatacttttaaagctgataaaaatattaaattagcgacttatgcatcgcgttgtattgaaaatgaaattttgatgtttttaagaaagaataataagttaagacatgaaatatctttagatgaaccgttaaatattgactatgatggtaatgaactgctgttatcagatattattggtactgatagtgatattgttaaaaatgaattggaacaaagcgatcaaaaaacgatgttctacgaagcttttaaagatttatcaaaacgtgaaaaagagattttgatgtttagatatggattgatgaattatgatgaactgacacaaaaagatgtggctaaaatgatgggaatttcacaatcatatatatcaagattggaaaagaaaattataaaaaaattaagaaataaattgaattataatgaaataaaataagtataaatttgtcatatttgctaaaaataagggtgaaagaaggcaaatatgaacaattatcaagttattataaatggttatcatgaaccaaaaaagaaacttacaactgaagaaacatatatattaatagatcgttatcaggcgactaaagatcctgaaattaaagagagattagttaatgataataccaagttggtcatttctatgacaaaacgtttctatggtagaaatgatagtagcgatgacttgttccaagttgggatgattggcttaattaaagctattgaaaactttgatactagttatggtttaaagttttcaacgtatgcagtcccattgattattggtgaaatgaagcgttatttacgtgataatcaccaaattaaaatatcacgatcaattcgggacctggcttataaaatactaaaagtaaaagatcagtatttggttaaattaaaacgtgaaccgacaattaaagaattgtctgatgaattggaagttgaacaaaatgccgtcattgaagccctattatcaactaatagtgtagcttcattacaagaagaagtgaaaaatgatgatggtaataatttaaagatgattgattctctaagtgatgataaaacggttgtatcaagaactaatgaaaagattgatttgtatgatgcgttgaaattacttgatcaaaaagaacatcaggtaataaaacagcgatattttgaagggctgtcacaaagcgaaatagctaaagaattatttatttcacaagcacaagtatcaagaattgaaaaaaaggcgttaaacaatctacataattacctaaaataagcatatattttaatggtgatttgatgagatttgtaaaactgcaatctaaagatgtagtcaatgtagttgatggctgtaaagttggttttattagtgatattgaaattgactggtgtaccagaagtatccaggcaatagttgtagaaaaatacagtttttttaaattgttttgtttttttaaagaagcgccatgtattgttattccttttgattgtgttgtaagtattggtggtgatgttattttagtttcgcttgaaccataaatgtttgaaggcaatgtaattttatttaaaattatgttgtctttttggattttgtgtttaaagataatgtgaatttaagtttttttagaatagaggcgttaattatgcttttatgatacgtttttttgtgctataatgggctggtaatgaaataaggaggatcacttcatgggatacggacaaaaagtaaaaaaatggttctttgatgaagacggtgatgaagttgaagaatatgatgaagtagaaatcgatactgagcctaaaaccagtttgtttgaacaagctaaattttcaaaaactagtgatgccattaaagcattaaatgctaataaagatagtcaattaattttatttgaacctagagcttttgcggaaacacaagatattgctaattatttgaaacagaaaaaagctgcggtaataaatctacatcgtttacaaaaagagcagtctaaacgtgttgtagatttcttaagcggggtaatctttgcaattgaaggagatattcaacggatcggacctagaatattcttatgtacacctaaaaatattggtgtttctggaacaattgatttagatgaagaggactcagaagaattataagtattagtttaactaatactttttaattatgcttgaacatttcaaaggtgaagaagtttttgttaaaaagattctagaatttaaagatcaagctttaaatcgacagagaattgttttaacaaagtttttaaacccgtatcatcagtcaattgtttatagtattattggtaaatcagatgatctaatcgtcttagaagatggtggtttgatcaatagtgagactaagagattgatcatcgcaccagcattttatcaaattgaaaaagcagattttgaaatagcgctggctaaaattacatatgcgaagccttttggtaaattaggtcatcgtgatattttaggagctttaatgtctttagggattaaaagagagttgtttggggatatttacgaatataatgatgatttttatgttgcgatggatttaaaaatttatgattatgtcaaagataatcttacgatgattaaaaaaaataaggtaaaattatctttatctgatgaagaaattgagatcgttcatcagtatacgagtaaaacttttattatttcttcgtttcgtcttgataaggtagttagcagcttttatggtctgccgcgcaacaaagcagtgagctatattcaatcaggttttgtaaaagttaatcacaaagaagttgaagaaataagttatttgtgtaataatagtgatgtgatatcgcttcgacgttatggtcgtgttaagtttatcgatactaaaagaaaaacaagacaggataattatgttgtagaagggtatttttataagtaagggagtgagacgatgaaagaaataaaaaagcagtttagaggctatgacatgcagacagttgataatttgatgatcgattatgaagatcaaatcaataagttaaaaaggcaggtagccactttaacgaatgaacttgaacatgccaaagagcaaaactctttattgcagcatcgtgtcaacattactgaaaagacaaatgaagagatagctcgtttagctctgaaagaagctagtgctttaattgataaagccaaacgtaatgccaatatgattttgaaagaatcattagattatgtacgttcactttcaggtgaaatgaatgattttaaagatcaggcaattaaattccgttcatcagttcaaaagatgtcacaggatatcttagatacgatcgataattcggaagtttttaatcttatcaatgaagaagatgagtaaatacaatgaaggagactgtttataataagatgtttatagagagctgatggctggtgtaaatcagtaactattattataatgaatcactctggagtagcgccttgaactcaagtagaggtcgccgttgatcgcgttaagattttaaagtgcgtattgaaaaatacgaattaaggtggtaccgcgaaatattcgtccttttttaagggcgttttttaattttatggaggagaaaaaatgaattacaaagacacattattaatgccaaaaacagactttgaaatgcgtgggaatcttcctaaaaaagaacctgggtatgtaagtcgctggcaagaagcaaacatgtatgaaaaggttattaaacaaaatgaaggtaaagatgcttttgttttccatgatgggccaccatatgctaatggaaatatgcatatgggacatatgttaaacaaagtcatcaaagatgtaatctgtcgttacaataacatggaagggcgttatacaccatatattcctggttgggatactcatggtttgcctattgaaaatgctattcaaaaattaggtgttaatcgtaaagaaatgtctacagctgcatttagaaaaaaatgcgatgagtatgctcatgaacaggttaataaacaaaaagaacaattgatcagaatgggaacatttgctgattataaacatccatatttaactttaacaccagagtttgaagctaatcaaattgatgtatttgctaaaatggcaatggatggtttgatttttaaagggttgaagccggtatactggtcaccatcaagtgaatcagcattagctgaagctgaaattgaataccatgatatcaaaagcccaactatcttcgtaaaattccaagttaaagatggtaaaggaattttagacaatgatacatattttgttatttggacaactactccttggacaattcctgccaatcttgcaatctgtttaaatgaagtgtataactatgctttagttgaaacaaataagggtaaattgatcgttttagaggaattagttgattctttgatggaaaaatttgaaattacagaatatcaagtaattgatcattttaaaggaaaagaattagaaatgatcacttgtaaacatcctttatatgatcgtgaatctttagttattttaggtgatcatgttactgctgaagctggtactggatgtgttcatacagcaccaggatttggggctgatgacttctttgttggtcaaaaatatggattgccagcttattgtaatgttgatgaacatggctgcatgatggctgattgtggtgagtggttagaaggtcaatatgtcgatgatgctaataaaacagtaactttaaaacttgatgaattaggagttttattaaaacttgaatttattactcacagttatcctcatgactggcgtactaaaaaaccaattatctttagagcaactgatcaatggttctgctcattagataaaattagagataaattattaaatgaaatcgataaagttaactggctaaatgaatggggtcatattcgtatttataatatgatcaaagaacgtggtgactggtgtatttctcgtcaaagatcttggggagtaccaattccaattatttattgtgaagatggtacaccaatcatggaagaaaaagtatttaaacatatttctgatttatttagaaaatatggttcaaatgtttggtttgaacgtgatgaaaaagatttattaccagaaggatatacgaatgaacattcaccaaatggtatctttaaaaaagaaaaagatattatggacgtttggtttgattctggatcaagtcataccggatgtatgttagaaagaggatacccatatcctgtagatctatattttgaaggaagtgaccaatatcgtggctggttcaattcatcattgatcgttggtactgcagctcatggctgtgcaccatataaaacagttttatcacatggatttgttttagatggtaaaggaaataaaatgtctaagtctttaggtaatacagttgatccaattaaattggttaatcagtatggtgcggatatcgtaagattatgggcaacatcagtagcttatcagcaggatgtacgtattagtgatgaaatcatgaaacagatttctgaaaactatcgtaagatcagaaatactatgcgttttgtgcttggaaacttaaatgattttaaacaggctgatttagttccggttgaaaaattaactgatgttgataaatatatgttagtagaattgaataatttaattgatggatatcatcaagcttatgataattatgattttgctgatgctaaccaacagatcttaaattactttactaatttattaagttctttctatatggattttaccaaagatattctttatattgaaaaagcagatagtttacgtagaagacaagtacaaacagttttatattatcatgctaaaactatgatgaaattgatttcaccagtgttagtatttactgctgaagaattacatgatcatttccattgtgatgatcaaaaagcagaatctgttttcttagaaccaaatgtagaaaaagtagtaattgaaaatagtaatgaattgaaagaatattttgatcgtttcttattattacgtaaagatgttttaaaagcgttagaaggattacgtaatgaaaaagtaattaaatcaaatatggaagctaaagtaactatttcattaaaagatgaatttaaagatatggcttcaatgttaaatgatttaaaacagttatttattgttgctaaagttgaattagtagatgattcatctttagaagaatatgacagtgcttatattaaggtagaaaaattcaatggacatcaatgtccacgctgctggaatcattttgaagaagatgaaatggaaggcgaattatgtcatcgttgtcatgatgtaattaatggttaaaattattataaattaaaagacaatgattcaatgcggttcttactcgcttatgggtaaatgaacttattagacagcacaagaaattgtgctgtttttctttagtttgtatttcttgtttttgggcattttgatacaatatatgtatggatggtgatacatatgaaatataatgaaatcagtttgaatgaaaaaatctttggtaatgacttcattgtctatgactggaaagaatcagataataaaatcataatatatgtgaaagcaacttctcatgatgatgtatgtcctgtgtgtggttctcctacaagttctttacataatacctatcatagaatgattcaggcttatcctgttagaaataaaacaacttttattgatgtgattgcttataaatatgactgtactaatgacaaatgcaatagaaaggttattatgcagaatcttccttttgtttctcctgttattcggtgaattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacatttctccctctcaaagaagaacatatgagcttaactatcttatccttgcagtttctctctttttaagcaatgaaggtgccagtaaagtactgaaacttcttggggtcaatgtaagcaatgactctatcaaacgcctgactgataagatcattattgaagatgaccctgatgtcgagtctattggaatagatgatgtggcgatgagaaaaggaaagacttatgcaactgccatatatgatatggaagatcatcatcttattgcacttttagatggaagagataaggaaacagttgttgaatggctaaaaaatcatcaaaaaataaagattgccacacgtgacagagcaagtgcatacgcttctgcaatcagtgaagttttacctgaatgtatccagattgcagacagatttcatcttcttcaaaatttaattgacagaataaaagatatttttaaaacggaaataccggaaacagtattcataaaagatggaaaggtactggaagaggaacctcaaaaggttccagcattaaaaatcgatccaaattcaaaggaacttgaaaaaaagaaatacacaacaatagctaaagaattttcaatatcaactctttctgcgaagaaatatgtctgtatgaatgaagaggaaattaaagcgttagataatcctaaaaaatacaaacaaagaaaaactgttactgatgattatatcaatatgatttataaaatgatcctggatggaataaagccagaaattatctttagttatgtcataaaaaaaggatataaaggtacgtggaagtcattggataacagaattgtatacttattaaaaaataattttagtatttctctttcaatggggtggcatattaagtataaatatccagataatatcatcatcataaaaagaaatgaaatattaaaatacataacaactaaaaatgagaaaacaaagaaaaataaaacagttgaaaaaaacattcaaataatcaaggaaagatatccaattataactgaactagaaaaaatatatgattcgttttacagcacgatcaaggaggcagatactgatcagctagataagtttattgataattatagagaatcagtattaaaaggatttatagaaggtatagaaaaagatattgccccgatcaagaacgcaatatcttatccatatagttcgggatttgttgaaggaaacaacaacaaattcaaactcatcaaatgtattttatatggaagaagcaaaatagtcaatctttttaggaaatgttacataccatttttaatgaataataaaaattttaagctaattgatattttagaacacaaaaacagcacaatttcttgtgctgtctaataagttcatttacccataagcgagtaagaaccttcaatgctaatcattgtcttttttgacttaaaataaaaaatcgataaaatagtctttatcgattctttttatttaaaattatttctccctgatttctttatttaagatgtctacaaaatctataagttcttgtttacctaattcagtaatactataagtagtttgtggacgtctattaacgaattcttttttcacggttatgtaaccagcttgttcaagtttgctagtgtgattagtcattgctccatcagcacatttacaaactttttttaattgattgtaagttaagctggaagtagaaagactagctaaaatttgaattctaatagttgaatcgaataccttagaagcttctacaatactattaatcatatgtttaccaatctccttaatataaaataattatttaatttataattattattacatattttagagctgtttgcaattgaaaatacctaaaattaaaaaaatgctgattatatctatatttattgtttttgtttaatgaaatattaaacataaattattgatgattccaaatggtttaaataaagataagacgataacgaattgaattttaaaaatggaatgtaagttatcaaaattagaaataataattaatttaaaatagatattgttgaaagatgtcgaaaatgttaaaatgtacaagtatattggaggggtgattgtgagtaataaggttaaaggttcattgttattagtattagcagcaatgatttggggcagctcttttattgtgatgaaaagtgccgtggattttttaacacctaatgtgttactttttattaggttttcactagctacagtaatcatgagtatcatgttttataaatatattaaagatacgaaattaaaagatctaaaaggaggaatgattactggtacatgtctatttttggcttatttagtgcaaacattaggcttgactatgacaactcctggtaaaaatgcatttttaacagcagtgtattgtgcaattgtaccatttctggtttggatattttatcgtaaacgacctgataattataattttatggcagctgtattatgtgttttaggtgtcggtttagtttctttagatggtgatttatccattaatatgggagatctattgacacttataggaggtcttttttatgcatttcatattcttgcaatcaagaagtattctaaagagatgcatccaataaaattgacaactttgcagtttgcaatgacagcagtattagcttttttaggatctttgttctttgaagatatttcactgatcaaacaaattgatagcagtattattatacagattggttatttagctttttttgctacagcagttactttgctttgtcaaaatgtaggacagcatttagttagtgagtgcaatgccgcaatattattaagtttagaatcagtatttggcgcctttttttcagttttattttatggggagatattaacattaaaagtatttttgggatttattataatttttgtcgcgattattgtatcagagacaaaattatcctttttaaagataaaagccagggaaggtgaattaaatgtttaaaaaaattgtaagttttattgttgctggattatgtttacttgctttaattaccccgctgcaggctcttgaaaatagtgcggatattggtttaacagcacaatatgcagttgccatcgatgctaaaagtggattagtactctacaataagaatatggatgaacggatgtatcctgctagcatgacaaaagttatgactacgatcgttgctattgagatgataaaagattttaatgcaacgactgtaatcactcaaagtgatattgatactgtttgggaaacaggggcttcatcagctaattttgaagtaggtgaaacagttacatataatgatttgttgttaggggcaattttaccaagcggtgctgatgctacaagagctttagcaaataatttgtgcggtggtcaagaagagtttgttaataagatgaatgagctggctgaaaaattagagttaaaagatactcattttgttaacacgacaggaattcatgacgagaatcattatacaacggttcatgatatggcattgatcgttaaatatgctgttgaaaatgaacaatttagagaaatatattcaaaacgttttgctacttcttcaaatgggttacatcaatgggtaaataaatcgatatataatgctaatagaagcaatattgatactagcagtattttaggttgtaaaagtggttatactgatgctgctaaaaactgtttatcgagtttggatatggtaggtaataatgaaattattactatcgtaggtaagtcgatcaataatgatcttaaacctcgtgcggcagtacaagatactttagatattgtaaattatgttagtcaaaattattcaatgcagtcaattctggctaaaggaacggaagttaaaagtttagatgtgaaagtggcaaaagataatcaaaagattttgattgaaaatcaaaatgatgtttctgcttttttacctaatgattttaataaagatgatttagagtataagtattcttttgaaaagcttgaggcacctttaaaaaaaggaaccaaagttggaaatttaagcatttattatggtgattatttattgtatcaagaagagtatttcaatgatataatgattgaacgtgatgctgtaagtgatatcaaggggaaaataatggattttatttttccttatggattagcgatcttcttagtagttctttatttctttatctctaaaataaaaaaacatcgaaaagtaacagttaagtaagactgttactttttttaaatatgatatactttaagtagagatattagaaaagatatttttgattattgaatgataataatttaaaaaaagagggatgaagatgagaaaatgttatcgttgtggtagtgaaatgttggaagaacatggcttgaaaataagttcgctaatggcgggagtagcaccggtattgttatctaaagggcaaggaattatgactgaggaatttggtaaagtaaaagcagcagtttgtcctaagtgcggggaaatatcattatatactgataatcataaggtgttagaaggaaaataataatattaatatataaaaatgatatcaatagagaaaggttacgtaataactgatcgtaagtaaaagggaaaaattatggaaactattaaaaagaataaaaaaactataataattgctggtgtgattgttataattggaattgttatagctgtattattatataaaaaggatgataatttaacagctaacgagatcttaacagctatgaaacaaaatgaagaattagaagggatgatttattcagatattgaaataacaaatattaatgatgatagtctcgaaatgttgggaaaagataatcgttatacttcaaaagttaaatttatggattcatctgacaagactgtaacggaagatgatgaatactgtagtggtgtgattgaggtttttaacaatgtagaagatcttaagatccggcaacagtatattacttatagtgatgaaaaacttaatgaaaactatgaaagtgaagaatttagtaaacttttaacattatttgataataactttaaagaaaatcatgtttataaaaatggaaatgctttattgatcatttctggaagtgttgataaaaaggtagctaaaaagtataaaaatgcttttgatgcagttttagaagacaaaacatatgagcaaaaagatatacctgacaaaaaacaaataactaaattaataaatgaagataaagagaagatagataaatatgtagaagaattgtcgctacaattagatgaactggtagaacagttatatcaatctattgatgaggctttagaagagatagcacaaaagcagtcagaaacggaattaaatgaaatgaaaaagattgttgcatgcttcgacagtgcaccacgttatcaagaaaagtataatcaatggcagacaaaagttcaggaaatagaacaacaaatagctgtgacaaaagcagctgaagaggcagaacgtcaaagaaaagaaattttagaaaataatcgtcatagtgcaggaatgtataaagttgggatagatattcccgcaggtgaatatgtattgattggtagtggatatttttcagttaataaagattcaagtgggcaattatctagtattatagctaatgataattttagtggtaactctattgttagtgtaagtgaaggacaatatctgacagtaagggatgcagttttttatgatataaatttaaatccagatgtaagtacaagtggagaaggaatgtttaaagttggtcttcatattcctgcgggtgaatataaattagttgccactagatcatcaggatattgtgaagtatcaaattcatcaagccatactttaggatcaattgtaagtaatgataatttttctggagaaaaatatattacagttcgaaatggtcagtatttaaaattaaatgggtgtaaaataaatcagtaatagtattatatatttttatctttatataaaaagaagctataattttaaggttttaactcgataataggtagttaaaaataagagatttcaaaaatgatcgtatttaataatcatttgagaaatctccttttttcatatttaccctaatttaataatcatttgagaaatctccttttttcatatttaccctaaagtaagaaagaaccaattttaattacagcctcttatcaatttattcatttacattttcaaatgcttggggaattaatggtgtaggtttttttattcgatgattataaacgagaatcgttaaaagactacaaataacaataattccaataaatacaataatttcataacttattgaaacattaggcatactaattacttttctaaagccatcaacactataagtgaaaggaacgaatggatgaatagctttaaaaattgctgaagatgtttccaatggatacgtacctgcagaaccgcccaagttgattaccataaaaacaagtaaaataaattcaccgatttttccacagacaatacttaataatgttactagcgccattgatgcagcaccaacaataacagcaaagataaatgtcattaataattgttgtggagcaaaatcacaaaataacattaatgatccaatcatcataacggctgcaatagtagaaatagtaaaccagacagttgctttagataaccagtattttaagccgctttcagctttttcaatatcattaaataatggatacattaaagtaaatgccatacaggcaacatataagccaacactcatcatatatggagccataccatgaccattattttctactgtagatatttcttgatgagatagttttactggcgttgataacatgtcaaatgtatcatcgctgcttttaatttcactgacttgtttagcaccatcacctaatgatgaagctaaagttgtagtaccatcttttaaagttgataagccatcatttaaagtatttgaaccttcatataattgattagctccagaagtgatttgtttagcaccgtcagctaactgctgagcaccattaaaaatagttggattattgctaattaatgtgttagttccagctaataattgattagaaccggttttagcactatttacaccattgctataagcagtaaaaccattacttaaagttgttgttccttgattaagtgctaaacttccctgatagattgagctagcaccgttaattaaagtatttgatgttgtttggtcacccaatcccgcctgaactgtttttaaaccagtatataattgtttgattgcctgattggcacctggtaaagcctgagcacagccgccagcaagagaactaacagtaagctgtagattgttaaaaacagtatcgatagtaactttagctgtttttacatttgtaactgcttttatattagcatcattaatattttgatcgttttttatacttgaaataatgttatcgattgtttcttgatcaagtatcttaccagcgttgctagtcaaagcgttttgtaaggcttgattataagcattgtttatttccgttatcgatgtttgagcactgtctaaagtgttatcgatgttattaagatagtcctttatattaggattattactgtcgttactagttgtttcaagactttgatttaatgcttgaataccgtaatttaaagtttctaaagctgttttaccagttattggattaggggttattaaagcattgataccagcttctgtctcactatttagttgattgtctaaagttgctttagcacttgtaagagcggtttctaactgtttactaccttcttttaattgctcaacaccagcatcaagctgattaataccaccagaaatggcctgagtgttactgtctaatgtatttaaaccgttatttaaatctttaacaccattattaacagagctaacgccatcaagataagaagaaagtccataacttagtgatgttgctccatcgttaaaaacaagggtactatcagctaatgtttttaaatttgttgtaattaagttattaccatcaattagttgactagcaccatcatttatttgacttgaaccgtcagcggcttcattcataccattaccaatattattaatctgttcaaaaatagttttagcatatgtcttggtaacagttgcagagacttcttctttgatctttgcaattgcagagtcatccatttttgaagcgatatagctagttccgggattagttgtatatgttaaaaccattttctccggttcttcctctaataatgtcgtcgcatttttagaaaaatcactaggaatagtaattatcatataataatcgccattttttagtccttgattagctttagtggcactaactaaactaaaattcattgaatcatttttttcaagattacttgctaattcttttcctacatctaaaacagtttgattatatgttactttttgatcttcatttactactgctacgggaatattacttgtattgccgtaagggtcccatatcgaaccaagaaaaatccccgaataaatacttggaattgcaatgatggctattgcgacaatgattaaccatcgattttttaaaaacgttgaccattctttttttatcataaatttttctccttccattagattttagtttatccttgaaatctaaataattaatggatataatttatccatggataaagtttatctattaacaaatacatattttagtcacatagatatgctttgtcaattaatttataaattatttttacagaaattattttatttatgatacaatatattgtagatgcaaaatgtcacaatataaatgagatgattaaggaaaataaagtgcgataatcaagaatgtcaaatgccgatatatgcatatgatagggaaaagttaataatatttataagttaggggtagaaatgatgaaagttaaaaatagtgtcgaacaagcaatatgcttattaataatgattgcgcatagtgatgagggaataccacttaaaagttataatatttctgagagtcttggggtctcagattcttatttaaaaaaaattattcgtcaattagtagtagcgggtttaattgcttctgaagcgggtaaaaagggtggagtctctttaaaaataccaccagaaaaaataactttgttagatatatttgaagcaattgagggtaaagaaccgtttgccaaggcaactgggttagttgaacgagtatttttaaatgaattaaaagaggtaaaagaacagaagcaggcaatgattttagaggcttttaatcaagctgaattaagttataaggaaaagttgaagacaattacattaaagatggcaatggtagaaagaaaaaataattcttgaaaatattacacataattaaaattacttgaattatgtaaaacaggtataaaattgaatagggagaagctatatacaaaaagtgtatagtttttttaaaaatttagttgtaactattgaaattacaacatatttgttatatactatggttgtaatggtaaagattacaacaaataaaatttaggaggaaattaaaatgaagatagcagttgtttgtgcaaatgggaaagctggtaaattgattgtaaaagaagccgtagaaagaggcttagatgttaccgctattgcaagaggaactaatgaaagtgtagcgcaaaattatattgaaaaagatttattcgctctaacaaaagaagatttagcggattttgatattattattgatgcctttggagcttggagtgaagaaaaattgccacttcatagtacttcattagaaaaattatgtgatttggttagtaataccgataaacgccttttagttgttggtggtgctggtagtttgtatgtaaatcctgaacatacaatgcaggttatggatggtcctgatttcccagatatttttaaaccattggcacatgctcaaggaaaagcattagatgaattaagaaaaagaactgatgttaaatggacatttgtaagtccagctggtgattttcaacctgaaggaaaaagaactggaaaatatattcttggtggcgaagagttaacattaaattctaaaggggaaagtactatcagctatgccgattatgcaatcgctatggttgatgaagctatagaaggaacgcatattcaagaaagaatcagtgttgttagtgaataaagtatttataaaagctcataagaaattatgggcttttgactaattaggagatgaaaaatgttacaagaagagcgcttagattatttaattagatatttgttagaggaagaacagaattatattttagatattccggatacagaaatagagaagaaaaaacttttgcgggcgcttatgaatgtgcgcttaccaaaaccaatttcacaagaatttttaaatatccaagaccgatatttacaagaagaactaaaaaaacaaaaaataatttctataaaagaattagttcccgtgcaaaaaggattatatttatggcaaggtgatattactaaattaaaagtagatgccattgtaaatgctggaaatagtgctcttttaggctgttttattccttgtcatggctgtattgataatgccatccactcttatgctggaatccagttgcgtttagactgtcaaaaaatcatggcacaacaaaataagcctgaagcaatcggaaaagcaaagattactaaaggctacaatcttcctgcaaaatatgtgctgcatacagtgggcccaatgatcaatggaagattggtagaaaaggataaaatattacttgcttcttgttatcgatcatgtttagaattggcagacctatatcagttaaaatcagttgcattttgctgtatttcaacaggagaatttcactttcctaatgatattgctggatatattgcagttgatacagtcacgcgttatttaaatgaaacgcactcagaaatagaggtgatttttaatgtttttaaagaaacagattggcagatctacaaacgattattggaataaaatcaaaaatctaagaagattgatagaacaggcagatgcgatcgttattggagctggtgcgggattatcagcttcagctggcttagaatatggtggaaaaagattttttgataatttttcagattttgctaaaaaatatggcttacaagatatgtattcagccggtttttatccatttgaaacgatagaagaatattgggcttattggagtcgacatattgaattgaatcgctatcaaaaaagtgtgggaaagccttatacagatcttctttctttagttaaagataaagattattttatattaactactaatgtcgatcattgctttcaaaaagccggttttgataaacaacgattattctatactcaaggagattatgggctttggcagtgttctaagggctgtcatcaagtgacttatgataatgaaaagcaagtcaaagaaatgattttgagacaaaaagaaatgaagattccatctaatttaattccatattgtccgcgttgtggttcttatatgacaatgaatttacgtattgatgataaatttgttcaagatgagggctggtataaagctttcaacagatatcatgattttttaaaacgacatgaaaatctgcatattttatttttagaattaggtgttgggaataatacgccagtaattataaaataccctttttggaagatgacagagaagaatccccatgctgtttatggatgtatcaattatcaggatgcttcttgtcccgtccaaattgaaaaacaatctatttgtattcaatttgatattggtaaagcactccaagatttgttatctagttagaaataatatatattattaaaaattttgttgagtagttgtaaattaattagtatgtagcaatcgattatgatcgattgcttattttctgataaaattatcttgcgccaaaaacgcataaaggcaaaatatatgctataatgtattacggagttgattagatgattaatacagttatatttgatttagatggaacattagttaattcattagaggatttagctgatacaaccaatttgttattaaaaaagagaggttatcctatttttgaacttgagcagtatcgttattttgtaggaaatggagtagctaaattaattgaaagggcattaccattagaacataaaaatgaagtaaaagatattaagcaggaatttgatgagatttatgctcaaaactgtttaaataaaacgagaccctatccgggtattattgagctattgaattatttaaaaaataatgattataatttagctattgtaactaacaagccacaagttcatgcttctaaaattgctaagacattatttcctgattgttttaaatatatctttggaaatagtgacctacatcctaaaaaacccgatccttgtttaactaatcttgtcattaatttatttgatgtcaaaaaagatcaggttgtttatattggtgatagtgatgttgatattcaaacagcaaaaaatactaaagttaaatcaattggggctgcgtggggatttagaggagcccaggaattaacaaaatgtggtgcggatcatgtagtttatcatgctaatgaaatattggaggtgctcgatgattggagtaagtagttgtttagcaggagttaaatgtacttatcgtggagatgataatttaattgaaatcataaaagaaatggttaatcgtaaaaaagcagttatgatttgtccagaggtattaggaggattgggaattcctagaaatccttgtgaaatcagaaaagatcgagttattgatataactggtgaagacaggacaaaagaatatgaattaggggctaaaagggctttagaaatattaaaagaacatgatgttgatgttgttttactaaaagctaatagtcctagttgtggaaagaataagatttatgatggcagttttagccatactttaattaatggtgatggaattacttgccaattattggagaaacatggcataatagtatttaatgaggataaaattgatgaattttttaaatttatagaaagaaggagagtagaaaatgggacatattttaaaagttaatcctgtatttaaaaaaatgatttggggaggacataaactaaaagatatttatggctatgatattccaagtgatcatacaggggaatgctgggcgatatcagcacatcaaaatggtgattgcacaatggctaatagtgaatttgcaggtaaaaaattatctgaattatgggctgaacatcgggaattatttgataatatcgaaggtgatcaatttccgttgttagttaaaattattgatgcctgcaatgatctatcagtacaggttcatcctaatgatgaatatgcggcagttcatgaaaattctttaggtaagacagaatgctggtatgttttaggaactgatgaaaataccaaaatggtaatgggacatcatgctaagactaaagaagaatttgtagcggcaattgaaaatgatgattatgataatttattgaataagtttggaatcaaagaaggtgattttttctacattcctgctggaacgattcatgcgatttgtagtggttcattaatttatgaagcgcagcagtcatcagatattacatatcgtgtatatgattatcatcgtaaagatgccaatggtaatgagcggcaattgcatgtacaacagtcaattgatgtaacacaagtaccatatcagccatatacaaatgagaatcaagtagttgcagaaattgaaaatggaactgttacaaaattaattgctagtgaattttttacagttaataaatatgacttaacaggtaaaaatacaattattaatgataaaccattccaattagtgacagtaattaaaggtgaaggaaaaattgctggtagtgatgtaaaaattggtgataatttcattgtatgtgccgatcaaaaagaagttgactatgatggtaatatgtcagtgatgatctgtacattatagtgctattaatatgaatcaaggataatgaagtagagctgttgttctacttcattttattaatgacagaaaaaacagtttatgatagaatgtatacaatctaaaagaaatgaggtagattatggcacatataaagtttaaatttgatgttttaaatgctttttgtaatgaagcttttgaaaaatttggattcactccagaagaaagtaaggttattaccgatgtcttgttattatcagacgtttatggaattgaatctcatggaatgcaaagactttcaagataccataaggggatcgaaaaaggaatgatcaaggttgatgctaagccggaaatagtttttgaaacgcctgtttctgcagtaattgatggaaatgcggggatgggtcagttaataagtaaatttgcaatggaaaaatgtattgaaaaagctaagaatgtaggaatagcagttgtaagtgttagaaactctaatcattatggaattgcgggatattatgctaagatggcttgtgaccaggggctgataggaatgtcttttacaaattctgaagctatcatggttccaacttttgcgcgtaaagcaatgctgggatcaaatcccattgctttagctatgcctgctaaaccatatccgttttttttcgatgcttcgacaaccgttgtaacaagaggaaaactggaaatgtaccgaaaggctgaaaaacagctgcctcaaggttgggctttggataaagatggcaatccttcaactgatgcacctgatgttttgactaatattacagataaagttggtggtggtattatgccccttggtggttctacagaacaattaggaagccataaaggatatggatatggtatgttttgtgaaattttctgttcgattttatctcaaggattgacgtcaaatcatacacataccgatggtattgggggaacttgtcatggttttattgctatagatccaaaaatatttggtgatcctcaagatattgaggcgcatttttcaacttttttacaggaattaagagatgctcctaaagcagctggacagacacggatttatactcatggtcaaaaagaagttgaagcggttaaagatcggatggaaaatgggattgcagttgatgtaaaaacggtattagaaatgaaagatttatctaattttgttggtgttgattttgaaaaatattttggtaaattagatattgatgatgcaaattataaaacagtttattaaggaggaaatttatggaatttaagtgtgtacattgtaatattaatattacaaatattgaaaagagtgtttcgttttatcaaaaagctttaggacttaaagtagaaagaacaaaagaagctagtgatggaagttttattcttacttatttaggagatgggataagtaattttcaaattgagttaacctggttaaaagatcatccccaagcatatgatctaggagaaaatgaaagtcatatttgttttgaagttgatgattatgaaaaggcctatcaattacataaagagatgggatgtatttgttttgaaaataaagcgatgggattatactttattaatgatcctgatgattattggattgaaattttaccaaaaaaataatgcttattctataacggataagcatttttattttttacttttttaaataactgatcatattctggtttgattttctttaaactaacgggtttaccatctttgttaataaaacaatgttttgaagtgcctgttgtacaaagaatattattttgattataaatttcataactacaagcaaaacgaacactgctgtattcatcaatttttactttaatagtagcgatatcatcaaaatacatcatttgcaagtatttacaagatacttctaatacgggagaaataatgccctctttctccattgttttataagttaaaccgatttgattcataaaatcaattcgtgcttcttcaaaccagcgaatataatttgaatgatgaatgatgcccatttgatcagtttcatagtatttagcaagatgctggtatggtttaatgttcatagtcttctcctaagataaagatttcacctgggtgatgaattttaataatattatgatattggttcagtggttcatggtcaagataatcgagcattttattgatatcatcaccaaaatgcatcggtaaaacatatttagttttaatatttttcaagatatgattcatgccccaccaggttgtttcttcaagacggggatctaaaggaatcatcattagatcaaaatttatattaaccagcttagcaatttcttttttaaaagtaacggcctggtattcattatccgtttctggttctcccagccaatgccaccagtgcaaatcaccagcatgatataaatatttgttttcaactttgactacaaaggcgactccttcatcggttgaaagtagtgtttgcagatgaagatcatcgatcttataagttttatgaggatatactttgatgcctttattatcaatttcatgatcaataatataagtaatattaggatgatcaagatcataaataacaggattatagtgatcataatgtaaatgggaaacaaagacgtataaagctttatttggatctaatttaggaagctttcctttaaagtaatcaaataataaaatatgtttttctaattccacaataaaaccactattatataaataagtaattttcatatcttagctccttatacaaataaaagggagtattattctccctcatcatagtttgcaacattgtgatagatctggtcaacatcatcacaatcatttaaattattcattaagcgttcaaataattccatgtcttcaccagcaagttctacagtatcttgaggtaaagtttgaatttcatcgatgtcaaaatcaacatctgctttaattccttcgattgcttctttgattttatttaaatcagttggctcaccaataattttaatcgaaccatcaccttcactaataatatcttttgcatcaatttcagccataactaaagcatctaaaacagtttcttcatctaatcccttgaaactaacaacactaatgacatcatataaataagtaactgatccttcatttcctaatttagctttagatttagtaaaggcaggacgtacttgtgaaatagtacgattaatattatctgttaaacatttaacgattattgtagcgccaccgttagcatatccttcaaatactttttcttcataattttcagtaacaccactttttactttatcaattgctcttttaatgacatcagcaggtacttgttcttttttggctttttcaatcattcgtcttaaagctaagtttccctctggttcaggacctccagctttagcaatcaagtaaatttcttttccataacgtgaatataatttagctttttttgctgctgtttttgccattgcaactttacgcacttcatgtgctctacccataaataattcctccttaaagtgataaatccttctaaattatacacttatcgattaatattatcaagtatactttttattacttataatcatctaaagtggaaattaactgttcattttagataattaaagtttattagcaccatttattttaaaagattatagattatgctataatctaggcattatacaaggagataaacgatggaaactactgtaattattggggctggggcaagcggattgatatgtggccatgaattagctgatcatcatgctaatgtaattattcttgaacagtcgaataaatccggaagaaaaatcttagctagcggtaatggccgctgtaatctttctaatactaatttagatatgcgtttctataacacaaatgataaacgaattgaaaaaattattcatgattttgatgcgaagacttattttgatcaaattggagtattaactagacaggttgggacattattgtatccccgttcaaatcagagtttaacgataaagaatgcgttgatgaacaattttgatcaggttgctttgattgaagagtgccaggctttaaaaataatcaaaaaacaaaaaggatatcttgtcaaaagtactaaaggtaattatgaatgtgataatgttgttattgcaacagggtcaccagcttcttgtttatcaggagaaaataattatgatttggttaaggaccttgaattaaagatgataaagttgtatcctagtctagttcaagtaaaaactaagccagcatacatgcaattaaagggtgtacgagtcaaatgtaaagctagtttatatctcgataataaattaattgaaagtcaatctggtgaagttctgtttactgatcaaggattatcagggatttgtattatgcagttatcaaggttattgccaggtaattgtaataatgctgtaatcagtttggatttattagaagatcttgatgatgaagaagttaaaattttattaaaacagcgcttagagaaatatggtaattattatcttgaaggaatatttaatgataaattagctaaagtattaaaaaatgtaaaaaatttaaaagatgttcgctttaaagtgctaggtacatatggttatcaaaaagctcaagtaatgcgaggcggtgtaagtcttgtagaaatcaatgaaaatttagaaagtttaaaatatccggggatttatcttgcaggagaaatattagatgtagatggcgactgtggtggttataatctacattttgcgtttgcttcaggatatcatatcgctaaaacgatattaagtaagggaagataagatgattagaattaataatttgaaagtttcattagatactaaagattatcgacaggtaatctcacaacaattaaatatttccaaaaataaaattaaaaatgtaaagttagtgaaaaaggccgttgatgcaagaagaaagaataaagttcattttgtttgtagttttgaatttgaaatagacaatgaagagatgataataaaaaaatatcctaaattacaacttagacaagtaaagccatatcattatccagtcttaaaagctaatgatgaacatattgtagtagtaggtagtggaccagcgggtttattttgtgcatataacttagctcgagctaaacaaaaagtgactttgattgaaagaggcagcaaggtagataaaagaaaagaagatattgataatttctttaaaactggtaaactgcttttaaatagtaatgttcaatttggtgagggtggtgctggaacttttagtgatggaaaacttaccacaggtgtcaaagataaaagaaaacaatttattttagaaacttttgtagctcatggtgctaatgaagatattttatatatgaataagccgcatgtagggacagactatttgatcaacgttgttaaaagtatgcgtgaaaaaataattgaaaatggcggtacagtgttatttgatagtcagcttgttgatgttgaaataaaagatcagcacttagtaaatattaaagtacgccagcaagatcaaatcatgacgatgaagccagatcgcttagttttagcgatcggacatagtgctcgcgatacttatgaaatgttgtatcaaagaggattgaaaatggaaccgaaagcttttgctgtaggacttagaatcgaacatctgcaatcatttattaatgaacatcaatatggtaaatatgcaaatcatcctaaattaaaagccgcagattataaattagctgttaaaacaagcagcggccgaggtgtttatacattttgtatgtgtcctggaggacgagttattaattcaagtagcgaatcaggaggtgtagtagtaaacggaatgagcaaccaggctcgtgatgatactaatgccaatagtgcaatcttagtaacggtgggacctgatgattttaaagatgatcatccgttatctggagttacctatcaacgtgatctagaacataaagcatttatacttggtggtagtaattatcatattcccgtgatgaaagtagaagattatttaatgaaacaagtcaatgaaagtactgttaagtgcagcgttttaccaggcgtgaaagaagcagatttaaatgctttgtttagtcccgagataaatgcatctttaaaagaaggattagaattaatgaatcaaaaattttctgggtttacaagtaatgcaattctttctggagtagaatcacgaagttcagcaccggttcgattttatcgcgatgaatcatatcaaagtaatattaaaggaatctatccaatcggtgagggagctggttatgctggtggaatcatgtcaagtgctttagatggattaaaatgtagtgaattaattttaaaaggggagaaagaaaaatgtcagtcatagaaattgcaatcattggaattggattagcgatggatgcttttgcggtctcaatttgtaaaggtcttgcaatgaagaaaatgagttatcaaaaagctattataattgctttgttttttggcgggtttcaggcactaatgccagcaataggatatgttttaggtactacttttgcttctaagattgcagcgatcgatcattggattgcttttatcttattaggcttaattggtgtaaatatgatcaaagaggctttaggtaaagaagatgatgagtgtttagatgatgctttacactttggtgatttgatcatgttgtcgattgctacaagtgttgatgctttagcagtagggatcacatttgctttttttaatgtttcaattgttttatcaacatcaattattggctttattacttttattatttgtataattggagtaaaagttggaaatgtttttggggaaaaatataaaagtaaggctgaattaacagggggaattctgttgatcattatgggctgtaagattttgcttgatcacttattcttttaggaaggttgaaaaatgatatgaaagtcgaaatattaaaaaaaagacgtgagcatcatacaatgcgtccgccaagacaaattgcgcttagttttttagcagtgatttttattggttcagttttattaagtttgccgatttgcaataatgcaagtcccacgtcatatttaaataatttatttattgccacttcagcaacatgtgttacgggattagtaccggttgtaataagtgaacaatttaatttgttaggacaattgatcattattattttgattcaaattggtggtttaggttttttaacatttttaaatttattattaataatgatcaataaaaagatttctttgacaaataaaatagttttgcaagaagcacttaatcaaccatctttaaatgcaattcccaaatttgtaaaaaatgtaattaaatatacttttataatcgaaggaatcggtgcaattttattatgctttgttttcattcccgattatggtttagttaaaggaatatattttgctgtttttcacgcaatttcagcattttgtaatgctggatttgatgttttaggaagtaattcattgattggttatcaaagtaatataataatcaattttgttatcccatctttaataattatgggtggtttaggttttattgtttggtttgatgttgctaaaacaataaaaaaagagtttcataaaccatctaaatttaacttttatcatttatttaaaaattttagtctacatactaagctagtcttagtgatgactgctattctattgattgcgggaatgattttattttatctatgtgaatttaataacccggatacccttggtaaattaaactttttagatcaattacaggtgtctttttttcaatcagcaacattgcgaacagcaggatttgcttctgtagatatagcgagtttatacccgtatactaaattcatgatgtgcattcttatgtttatcggtggatcacctgccggtacagcgggaggaatcaagacagtaacttttgcaatcagtattttaatggtctataatatttatcatggtagaaaagaagtagctgtgtttgccagaaggattcctaaacgtttaattattcgttcatttgcaattattacgattggtctttctttggctcttataagtatttttattttaagtattagtgagaatgctgtttttgttgatattatgtttgaagctgtttcagcttttgcgaccgtaggattaagtgcatcgttaacaccttcacttacggtaattggtaaaataataattattatcttaatgtatattggtagaatcggaacaattactttgataatatcatttgctagaaaatcttatattaatgcaggaaaaaaagaagtaagatatactgatggtaatatcttgctaggttaggagtagaaaaatgaaaaataaacaatatgcagtattaggtttaggggtgtttggatcaactgttgcaacaacattatcgcagtatgactgtgaagttattgcaattgataaagatgaatcttgtgtagaaaggattgctgatgaggtcactaaggcagttgttgctgatactactgatatcgagcagttaagagcactagggttggatgatattgacgttgctgtgattgcaatcgggacacatttagaagaagctgttttaacgacgatgaacgtaaaggacctaggggttccatatgtaattgctaaagcgaaaaataaacagttttctaaaatattagaaaaagttggcgttaataaagtaattagagctgaaaaggatatgggaattagagtagctaaatcattgcttagaaaaaatattgttgatttagttgaattagacgaagagtattctttggtagaaataaatgcaccacatgattggactggtaaaagtgttcaagatctagacattagaaaggcttttcatatgaatattattggggtaaaagatagtgaagataatatgtcattaaatattggagctgattatattgtaaaaaagggtgatcgttttttagtgattggaaagactactgaaatagaacgatttgattattttacagaatagaaagagcagtactaaagtatggaaatctataaaagatagccatacttttattatttgcttattaaaaaaaataaatttataaatgatttttaagtaattgttaattatcttgtattttagctaaaatatgataaacttcttttgaatgtatcaaagccgttgagaaaattagacaaatgagctacaatgaatgtattagggaggtatctttggatgaagattattattttgggagcgggaaaagtagggaaaacgctaacccaatatatggctaatgaagatcatgatattatcgttattgatcaaaatgcaactaaggtcaatgatgttgttaatcaatatgatgttattggggttgttggaaatggtggatcgtatgatattttaatggaggctaatgctgatgaagctgatttgattatttgtgtaacagcttctgacgaattaaatattttagctggattaatggcaaaaagaatggggacaaagcatacgattgcaagagttagaaatcctgattattcaaaacagcgcgactttatgagaaatcaattaggattttcattgattattaatcctgaattagaagcggcaaatgaaattagaagaacgttgtcattttcttcagcagtaaaagttgaaacttttgctagaggaaaagtcgaacttgcggaatttaatgttgatgaaagcactcagctcaataatattcaactaagtaagttaaataatatttctaaagctaatatcttagtatgtgcagtaagtcgtgatgatgaggtaattattccggatggtaattatgtaattaagacaggtgatcatttatatataacgggatctcatcgagatttgacaagattctgtttagatattggaatcattactaagcaaataaaaaaagtaatgatcattggtggcggaaagatcgcattttatttagctaagcagttaagtgttttaggaatgcgcgtaaaaattattgaaaataacacagaacattgtaaagtattagcaaaaaactaccttttattacagtcattaatgcagatggtagtgatgaagaaatattagttgaagaaggaattgaaaatatagatgcatttttagcattaacaggattagatgaagaaaatttaattttatctttgtatgctaaaaaaatgtatcataaaaaaacagtggctaaagttacccgaatgaattatgcgggattagttaatagtcttaatgtagatacgattatttcaccaaaaagtgcgattgcagctcagatcgttcgttatgtaagggctaaggttaataaagatgatgattccagtgtcaaaactttatataagatcgtgaatggggaaattgaagcaagtgaatttgtagttactaataaaatttcttttttaggtaaaacattaaatgaattaaaattaaaaaatcatattttagtagcagctatttctagaggaaatgaaatgattgttcctaaaggtggaaccacaattgaattaggtgatcatgtaattattatatctcgtgatgaaaaattaagaacattgaatgatattataaggagataaccaaatgaataaaaagatgatcatttttacattagggaagctgttacaaataacaggattactaatgtatattcctgtattagttgcaataatatatcaagaagcagaaggaattagttttgcaattcttggagctttgatttttggcttaggaacgattatttcatttaagcacccagctaaaaaaaatatttatgctcgtgaaggttttgtaatcgttgctttgagctggatcttaatttcgatttttggggctttaccattttgtttaactggcgaaatcccgtcatttatagatgctttttttgagatggtatccggctttacaacaacgggttcttcaattttgtctgatattgaagcattaagtcatgctagtttattttggcgtagcttttcgcattggcttggtggaatgggaattctggtttttgtgattgcttttgtaccaatttcctcagggcgttctttacatattttaagagccgaggttcctggaccagtagtaggtaaattagtttctaaaattcgcttaacagcaagaattttgtatattatttatgctgttttgacgttagtagagacggttttattgttgtttgggggaatgccgttatttgatagccttttaaattcatttggaacagcaggaactggtggatttgcaatcaaaaatgctagtattgctgcttatgatagtgtctatgtagataccgtgattacgatttttatgattttattcgggattaattttaatttgatttattttgtaattattggaaaattcaaagaagtatttaagagtgaagaactgcgttattatttcttgatcattattggtgcaactattctaattacaatcaatatcttaccaatgtacgaatcgattttttcagcgttacgttattcaagttttacagtcggttctattattacaacaacaggatttgtaacagctgattatggtaaatggccaatgttttcacaaatgatcattattattttaatgtttgttggtgcctgttccggttcaactggtgggggaatgaaagtatcaagaatttttatttatttaaagaatgcgaagaaagaattaaaacacttattacatcctcatagtattcaaacagttgaatttgaaaaacagccaatagatgatcatgtaatcgctaatattcattcatatctagttttatatttagttatttttgcattatcactgctggttttaacgatttttaatttagatttcaaaagtgcattttcagcagttgctacttgtttaaataatgttggacctggttttgatgtagttggtcccgttagtaatttttcatcattatcggatgtctcaaaattagtcttatcttttgatatgttggcaggacggttagaaatttttccgattttattattatttgctccatcacagtggcgtagatagcataaaaaaaggtaaattgtgtagactatagagaggtgatttgatgaaaaaggaagaacttgtaataaaaaatgcccttcgaatgacgaaagaggctgatgagcatctttctgtctatgcaactaaaaatagtgattgtattaaaataaaacaaattattaaggataaagaagaatttgatattcgctggccttttgaagaagatatagatcgaattttatattgtaaatcatatcagcgttatgtcgataaaacacaagctttatccttttttcgtaacgctcatatttctaaacgttcaattcatgtccaatgggtcagtcggattgcaagacagatcggcagaggtttaagcttgaatctggatctaattgaagctgctgctttaggccatgatttaggacacgcaccttatggtcatgttggtgaaaaggcattgaatgaaattcttcaagataagggttacggttattttgcccataatgctaatagtgttcgaaacattttatttattgaaagaaagggaacaggatataatgtttcattacaggtattagatgctattttatgtcataatggtgagatgttatcgaaaaaatatattcctgatactaataaaacaattggacagttttggcaagagtatgatgattgttggcataaatgtgatacgagtaagaagattcgtccaatgacattagaaggctgtgtagttagggtttctgatgttatttcatatattggcaaagatattgaagatgcaatcagagtgggaattataaaacaaagtgatcttcctaaagaggctactgatgttttaggctttgataataaatcgatgatcaatcgcttgattggtgatttagtaattcatagttatgagttgccatatttacgtttttctaatgaagtatttgaggcattaaaaagtttgttaaattttttaacgataagagttcatcaacatcctgttttagttaaagaaaatactaaacttattagaatgatcaaacaattatatgatgtttattatgaagagctgactgatccactaaataaagattgtaaaataaaagcgtttgttgctaaaatgtcatcgcagtatcaacgtaatgatcctgctttgatcgttgctgattatttatcaatgatgacagactcttatgttttaaatgagtatgaaacaatttttttaccaattcagcataataaaataatttagtataaattatcttattggtattatcttttttaaattcgtagtataataattttataaggaggagttactatgaaactaattattgcaattgttaattctgatgatagttcagctgttcaaggagcccttactgaaaagggatattttgttactaaattatctacaaccgggggatttttaaaaaaaggaaatacaacattttttgttggaactaatgatgataaagttgaagactgtatttcgataattaaggctaatgctaaaaaacgggttgaaaaagaaccgactattcctccaactgaaatgggagagttttttacgccaatcatggtagatgttctagtaggtggagccactgtattcgtacttaatattgatcagttcgaaaaattctaaaaaaagaagtagctatgctacttcttttagcatataatgttttaaggtgataataatggagtataggttaataaaagaaaatgagatagaagcagtaattaaattagttcaacaggttgctaaagaatttatctttgctaatttagaaagtaatggatcaaaagactttgaccagctaaatacaaaagaattttatttagataagtctaatcttacatatatttgtttaaacgataataaaattattggtatggttagtttaagtaaaggaaattatttaagtttattatttgttgataagcaatatcagagaaagggaattggaaaaagattagtagaaataattgataatctagttttaggtgatcttgaagttaatgcggctattaatactagatcattttatgaacatcttggttttaaaataaacggtaatttagaaaaaaaagagggaatattatattatccaatgattaaaatgagaagcgtaaaaaaacgctttaataattatgatgaagttgtggaatttatcagtagtcaaaaaaatcgtgtttatagccttgataattttaaacgctatatggaagatctaggtaatccgcagttgattttagactgtgttcatattggtggaacaaatggaaagggatcaacaactaattatattaaagaagtattaaagcaatcaggatataagattgccacttttacatcaccagctttatattcaagattagatattattagaattaatgatcaatttatcgatgaacaaactatggtggattatgctaatcgctatgttgatttgtggttgaaatatgaaatttcaatgtttgaaattgaagtatttattgcaataatgtattttattgaacaaaaagttgatttagcactatttgaagtagggttaggcggtttattagatgctacaaatatcattatgccaaaactagcgatcaatactaatatcggtttagatcatgtagattatttagggcatgattatcaaagtattgctttgaataaagcgggaattgtaaaagatggaatcgattatttaacaggtgagacgaaaacagaatgtttagaagtgtttaatgagatatgtcgcaggcatcatagtaaattgttaactttacagccaattacaaatattttagacagtaataatgttagttatcgttatcgtggttatgatattatcctggatacccctgctttgtatcaaatatataatagtgctttagctttagaagcgttgttatatttaaaaaatcatcaaatcgttgattttagtgatgatgacttattacaaggaatgtataatgctcgctgggcaggacgttttgaaatcgttaatattgaacctttgataatcattgatggagcccataataaagaaggaatcgatgctttttatgagtgtgctaaaaagtatgatcaaataaaaataatttttagtgctctccgtgataaagattataagcatatgattgaaaaactgctccaattaactgatgatattacgatttgtgaatttgaacacgtaagagctagcgatgctaaaacgcttgctgatggttttgatgttaaaattgaacctgattataaaatagctcttgatcaagcgtttgatcatgagggaacggtttttgttacaggatcattatattttatttctaaagttagagagtatatcatggaaagatcaggataaaatgctgatctttttttgtttgcttaaaattattgtgttataatcttataaactaaaaaaggagataagtgaatgacattatttttattatttattgctgctgttatcattatctgcatccttgctacaagactttcctataagtttggagttccgactttgttgatatttatcttattaggaatgatttttggaagtgatgggatatttaagattagttttgatgattttgttattagtgagaatatttgtacctttgctcttatatatataatgttttatggcggattttgtttaaattttaatactgccaaacccgtattagttaaagcaacgatcatgtcgactttaggtgttattttaacttgtggttttgtaggattattttgttatggaattttaaaaaccagtctgcttgagggaatgttgataggtgcggtcgtagcttccaccgatgcagcttcagtgtttagtattttaagaatgaaacgcttaaatttaaaggaaggaattgcaccgttattggaaatggaaagtggtagtaatgatccaacagcttatatgttgacggttattattttgacacttttatctggtaaaacgactaatatatttatgcttatattaagccaggtgctattgggaggcttatgtggggttgtgattggttttctggcgagaaattttttggatcgaattcgattaaatgaggttggtttaaaatctatttttgtagcggctctagcgctactggcttatgctttgcctagtgtaatgaatggtaatggttttttaagtgtttatttatttggaataatattaggaaatagtaaattaaaaaagaaaacatctttaattcatttttttgatagtatttcacatatgatgcagatcttacttttctttttattaggactattatgctttcctttacagctcattgatattatttcaccagctattttaattgctttatttttaacttttgttgcccgaccgctaaccgtatttatttgtttaactccttttaaagttccgttgaaacagcagttattcatttcctggtgtggtttacgaggtgctgcttcgatcgtatttgcaattatgacagttgtatcgccagcttatacaaataatgatatatttcatattgtatttttagttgctttactttcaattacttttcaggggactttgctgcctttgatggcaaaatggtttgatgtagaagataatcgaaatgatacgatgaagacatttaatgattatactaatgatagttcttttgaactggttaaaatatatttggataaaaatcatccttggatcaatcagacattaggtacgatcataacacctactgacatgttggtagtaacgatcattcgcgataatcaaatgattttacctaaaggatcaacaagaatcatgtatcaggatatcttgatcatgtgtgctcctagttatgaaggtaatgatatttatcttgatgaaatatgtattgaacagtcacatcattggattggggcaactttggcgaagataaatcctgctaataaatttttagttgtatttatcaagcgtaataatgagattcttattcctaatggtaaaacgaaaattaaacaagatgatatcttagtgatttgtaaaaaggagtatttaggttttgttgataataactaaattacttgatgtaaacagttatttatagtatgattctaattgtatacatttttgtatataatttagaaaaagggggagtctactttttagtagcaatcgcatgtacggtcattgatcggaattaacgcctgtggactagaaatgaggatgaagcaggaaagattgtaaataagtagcaatcagattatgattcaaattatttgcggatttattttagttttgatcggggtattggtattttggaaatacccaatcaaaagtgacacgaagtcacttacgttagctgctttgtttattgtactggcagcagtattaaaaaggttatcaattatgataccgttatttggttttgagagtttaaaaatctctattgaagttattccgatgctgttagcaggaataatgctggcacctggttattgttatattatcgggattgctgtagatttagttgggttgatcgtgacaccaacaggttttccgtttttaggatttacattaagcgcagtactacaaactttgattccatcgatagtggtggtaacggtaaaagaaaattatactcattttttagagaagatcattcaagttattttagtgcttttagcaatcagtgcctgtggttatgtttttagtttagatcaagtaactatttcgaataacgtggtaaatattacatttaattataaaattgcaattagtgttatttgtattgtaatgataagtgttttatttattgtaatgtattattataaaagaaagttaaatgagtcagattatcacttatttaatttatggcttatttccgtagtgcttgttgaaatggtaattacgttttgtttaacgccatattggttgcaagtgatgtatggaataccgtttacattatctttatttattcgagtaattaaagagtgtattatgattcctgttgatatcattttaggatatagtgttttaaaagttttgaaacgattatagagtcttttaattaaggctcttttttgtttatttttagaaaaattggaaaaaatattgtgaggtgaaattaatgaatacatctaagtataatcagattgcagaaaagctaaaaccgcaaaagcaggtaaaaaagcattgtttaagtgcctttatttatggtggaataataggtttgattggtcaaggattattagatttttatatgacgatttttgatattaaagaaaaagaagcgacaccgatgatgatcattacgattgtcttagcggcagctattttaaccggactgggaatctatgatcgtatcggtaaaaaagctggtgcgggtacctttattccaatcacaggtttttctaatagtatgacatctagtgcactggaagctaaaagtgaaggattagtaacaggtatcggtgctaatatgtttaaactgggtggtacagtaataacatttggaatcgtagcttcgtttattttaggaggaattcgttatgtcatcagtcttatctggtagctcgatgattttaaaaaatgtttatattagagcaattggtactacttgtggaattgatgaatttaatggtccgttaggtgattattttgatcagcattatcctgattttcgctttggcaatgattcttatgagcaggcagaaatagcaatgttacaagatgcccttggcattgctttaaaaaaaggtaaattaaaaaaagaagatattaatgtatatttaggtggtgacttaaataaccaggttactgctagtaattataccgctaaggattttcaaagaccttttatggcgatgtatggtgcgtgtgctacaatgggtctagtgataaataccgctgctatgttgattgaaaatcatagtttacataatgctaattgttttgtatgtagtcataatgctacagcggaaagacagtttcgctatcccgtagaatatggtgtgcagcgtaaagaaacaatgacgactactgctacaggagctgtaagtgtgattcttgataataatcctagtgctattagaatcgaagctttaacgattggtcgcgttgttgatatggatcaaagtgatcctaatgatatgggaagggcaatggcaccagcggcttttgatacgctatgtaatcatttaactgatcttaaccgccaggctaattattatgatttgatcgtcacaggtgatttatcagattatggtaaagcaatcatgaaggaattgatgaaagaaagtcatattagctataaagaatatgatgattgtggcagtttattatatagtaaggatcaagatgttaatcaaggaggcagtggtccttcatgtagtgctttagttacttttggatatttataccaaaaaatgttaaagcataagtataaaagaattcttgttattactacaggtgctttattatcaccagtaatgactaatcaaaagcaaagtatcccttgtattggtcacgcctttagtttggaggtagtagaataatgaattatattttagcatttattttttgtggttttgtctgtgtcgtggcgcagcttatttatgagtacactaagttgacccctggtcacattactagtatgttcgtggttattggagcgtttttagatttgtttcatatttatgataaactagttgaaatttttcatgcgggagccttgcttcctattactagttttggtcattcattaatgcatggagcattagcagcaacgaaagaatatggtttttttggtctggcactgggggtttttgatttaactgccgctggaatcagtagtgcgatattatttgcttttcttgttgctgtatgtactaaaccaaaatcataatgaagaatccttcttttgatctcaatacccgaacacttgattttgaaaatgaagaagtaacgatcaattacgtctcaagcctttgttctgatgatttaattgcatatttagtcgaaggaataacaaatcatcgaggaaaaacattaaaagactgtataaataatggtgatgtaaaagaagaaacagatcttgaaaaagcgcagtatgcgatgttgacaggttgtgcagtagtaaattatcgtgataaacagtatgtattagatacaaggaattttcccagccgctctgtcgaagaacccgaaacggaaaagagtgttagaggttctaaagatggttttaatgaatcaatgcttacatgtgcaggattgattcgccggaggatcagaacgatcgatctagttatgaataagcaaacgattggaaaaaataatcctttagatatttgtttatgttatttaaatagtcaagtcgatcaaagtatgctacagacgattttagagcgaattaaagaaattaaaaatgaagatctagtaatgtcagatcgagcagttgaagaaatgatcttagatcaagggtacaatccttttcccttagttcgttatagtgaacggccagatgttgtatcgacacatattttacatggccacattgctataatttgtgacacttcgtcatcagtaatgatgattccaacgacgatatttgaaattttagaacatgttgaagaacatcgtcaaactccaatcattggtacttttattcgtctgattcgttttagtgcggtattaatttcgctttatttagttcctttatggttattattaacaaatgatgggaatcttgatctagtttttttgggacaagtattattagtagaacttgcaatcgaactgcttagaattgcaacgattcatactccgacgtcattatctaatgctatggggatgattgctgctgtattgttaggtcagtttgcgattgatcttggtatttttagtgaagaaattttacttttttgtgctattggtgatgttggtggttttgcgacaccaaattatgaattatcacttactaataagtatctaaagatttttttgataatctttgcaggatttttaggctggattggctttattatttttcatattattttaattggatatttggttagattaaaaccacttggtacttcttatttgtatccactttatccttttgatggtaaagagatgcttaattttattattcgtaaaccaaaaagtaaaagaggatcgtaaagccttgattatttatataattgaggtttttttgtaaaaaaaagaattcttctaatactgcaatttatgtgttataataactaatgcgtaattaggaggtttcatcatggaatatcaggtagtaattgaagactttcaaggacctttagatttattattacatctaattaaagaaaaagaaatggatttggaatcgttagaattatctgtaattgctgatcagtatttgcaatatattcatgcgatggatccatctttattggaagtgatgtcagaatatttagtcatggctgctgatttgattgaaatgaaaagtaaaatgcttattcctaaagaaaaagtaacgatcaacgatgactatcaagaggatcctcgagaagctttaataaaacgtttgattgaatataaacgttataaagatgttcttgatgatattcgtgaaaaatatgaacagcgacaaaatatcatcattaaaccagcagaatcaatggatgaatatatcatagatactagttctatgatacctgaaggtttggaagtatacgatttaatgaaggcaatgcaaaaaatgtttcaacgaaaggctctgatgaagccgttagatactcatattgctaaaaaagatatttcaattgatgaaagaaccgaacaaattagagattattttaaaacgagggtaaataaaaaagtaaaatttgaagaattatttgatcgatatgaccgcttttattttattgttacttttattgcaatattagttttagctaaggataaagaagtagaaataattcaagatggattatttgcggatatatatgtagaggggaaggtttaatggaagaaactaattacttagacattatagaaggaatgctgtatttggcaggggatgatggggtagatactaaacagattgccagtgtgttagagataagtcgtaaagatgcggtgttattgatggataaatttgttgaaagttatgaaaaaaaagcaataaagggtgtgattttggttaactttgggggacgttataaattagctactaatagcgagtattttgcttattatcaaaaaatggttgaacaaagcagtgctaatttatctaatgcagctttagaaaccttagcaattattgcttataatcagccaattacacgagtaggaatcgaagatattcgtggggtaggatgtgatgcgatgatccgtaaattagttgctaaggcattgattaaagaagttggtcgtgaagatagtccggggatgccgattttatatggtgtgactgatgaatttatggatacatttggactggcatcattagatgaactaccggccttagcagatattgttgaagttgatgaacaagaagatatctttgcaacaagatatcgtgaagataacgaggcgagcaatgaaagccattaaacattttaagacaattactaaacataaatattatgtgatgaagttatgttttcgttttggtttatataaacagggattaaaacatgatttatcaaaatattcatggagtgaattttctactggtgctaaatattatttaggttataaatcacctaatagtaatgaaagagaaatgattggttatagtagtgcctggttacaccataaaggacgcaataagcatcattgggaatattggatcgattttacaagccaaggtattattgcaattgaaatgccaattaagtatgtagtagaaatgttttgtgatcgcgtagccgcgacgatggtttatcgcggtaaagattttgattttacagcccctttagattattataataaaacaagattctattatgtaatcaatgaaaatactgatcggataattaaggatatgctggaacatttagcaaattcaaatcttgatgaaacaataaaatatattaaagaaacatatttaaatggtacttataaataatagtttgtaaaaccaggtagaggaaaatataatgaataatactgaaagaaatactggtgaccagcatacgattacagattggccgatagaaatacaaaatatcaatgatattcctagtgattttcaaaagcaggttttaacagcttttggggataatgtttttgattatattttagtatatgcacctgcatgttcgatgataaaagagtcgttagcatatttatttgcttatggtaataatagaatcttttatttttataaagaaaaagatagtattaaacagactattgtagaacgaaatgatatttttgaagtgataacgataaaagaacttttaaatactaaaataattataaaatataaatacggtgagctggtatttccatatgtttcttcgtcatattatttatatgaaccatttttaaattggagtctaggtttaaaaaaagactttttaccatcttcgattgaacgtaataatccgcgaccaagatcactttatcaggatagtttaacgatgtttaattattcattggcagcatatcgactaggaagcaaaataaaaaaatatgattataattttcaaaaacgcaaaaagaaatggatgccttggaaaagcagcatagaagaatggttagatgttgaaatggaaaggggtacttttcatatatatagttttgagtatcttactaaatgtatttataagttatttggtaactaaaaagagcatcgtttaatgtcttggtcaaagacattaaattttgctcttttattattaataaacaatttatttaaatcgtgctttctttgaataatgtgtatgcaatagatgatgagctttttcgctgtttggttctcctaagaaatcagcatataacttttgaatttgtgagttcttatgagatttacgaactggtaatgctagatcttcatcatatagagctttcgcacgagcttgtttccagtcaaaaccactgttacgagttaacgcattgatgtaagattgaccaccaccgttgacacagccacctggacaacccatgatttcgatgaaatggtattttgaagtaccatttttaatttcttctaataatggtttagctaaagtcatactatgagcaacagcaacatttactgttagatcaccaatttttatgcaggcttctttaacaccttcttcaccacgaacggcatgatattcgatcgtagataaatcttctttggttaaaacatcagctactgttcgtaatgcggcttccataactccaccgctggcaccaaagataacccctgcaccagtgtattctccaaacatatcttgatcaaaatcttcatcttttaagtcacggaaattaataccaaacatcttgatcaatttacctaattctctagttgttaatacagcatcaacatcttttaaaccgtcagtaagattttcttcgcgttctttttcaccttttttagcgacacatggcatgattgaaacaacataaatatctttaggatcaatgttgttagtttttgcataatatgatttgatcatcgcacctaacatcatgtgtggtgatttacaactagataaatgatctaataaatcaggatattcatgttcaatataattgacccatcctggactacaagatgtaatcattggtaaaacaccattattttgaacacgactaataaattcatttccttcttccatgatagttaaatcagcaccaaaattagtatcatatactttatcgaagcccattaactttaatgcatgaaccattttaccagtaactctagtaccgatcggcattccaaattcttcacctaaactagctctaactgctggagcagtttgaacgatgacatgtttagttggatcatttaaagcaatgatgacatcatggacttcttctttttcatgtaaagctccaactggacaaacattgatacattgaccacattgcatacagttaacatcatttaaacttttatcatatactggaccaactttagttttaaatccacgattcataaagccaagaattcctaaaccttgatgttttgcacaagtttctacacaacgtccacataacacacattttgaagtgttacgaacgattccaggagatatttcatcaaaagttggagtggttttttcacctgcaaaggcatcttcacgaactcctaattcttgacataatctttgtaattcacagtttgtattacgaatacaagataaacagtctttagagtggtttgaaacgattaattcaactactcttcttctggcatctaaagctctttgagaattagttcttacaactaatccctctctaacaggataaacacaagcagcacatagtgttctagcaccttcaacttcaacttggcagacacggcaggctcctgttcctgtaacatcttttaaataacataaagtagggatatggattccgttatttttggctgcttctaagatagtttgcccttcataagcctctacttcacggttattgatcgtcatttttatttttgacattccttacacctactttctttcaattactttaaagtgacaagctttgatacattgaccacatttaatacatttttctttatcaatgacatatggtactttaccaagttcaccatgaatggcaccaactgggcattgttttgcacaaagaccgcatttacgacatttatcttcatcaataacatattgtaacaattctttacaaactccagctggacattttttatcaacaatatgagcgatatattcatctctaaattgattgatagttgaaagaactggatttggtgctgattgaccaagaccacatagtgctgtatctttaattgttgaagctaataactcaagctcatcaagagtttccattgttcctttaccatcacaaatttgttcaagtaattctaacattctttttgtaccaactcgacatggcgtacatttaccacatgattcatcaacaataaaatccatatagaaacgagcaacatcgaccatacagttatcttcatctaagacaatcattcctcctgatcccatcattgaaccaagtttaactaactcatcaaaaccaattggggtatctaattgttcttcagttaaacatccgcctgatggtccaccagtttgaacagctttaaaacgtttattattaggacagccaccaccaatttcataaattacttcacgtagagttgttcccattggaacttcaactaatccagtattaacaatttttccacctaaggcgaatactttagttcctggtgatgtttctgtaccgatcgatttaaaccagtcagcaccatgttgaatgatttgagcgatatttgcataagtttcaacgttattaataatcgttggtttaccccaaacacctttatgagcagggaatggtggtttaggatttggcattccacgttcaccttcgattgatttgatcaatgctgtttcttctccacaaacaaaagcacctgctcctaagcggatttcaagttcaaaatcaaaaccactatcaaaaatatttttacctaataaacctaattcctgagcttgactgattgctgtttttaaacgatcaacagcaattgggtattcagcacgaatgtagatataaccatgattagcaccaattgcatatcctgcaataatcatagcttcaataacactatgtgggttaccttcaagaatagaacgatccatgaatgctccagggtcaccttcatcagcattacaaataacatatttttcttcgccaggttcatttaaagcaaactgccatttaacaccagtagggaatcctccaccaccacggccacgcagaccactagctttaataacatcgacaacttcttgaggagtcatttcttgtaaaactttggctaaagcaaaatatccatcttttccgatatattcgttaatattttctggatcgattacgccacagttatgaagcgcaattcttttttgtttattgtaaaattttgtatcgttaatatcatgaatttctctagtttcttcatcagattcatttaacattaaatgatgaaccggacgccctttatagaagtgctccataacgatttcttttacatcttccggttttactgttttataaataatattatctggataaatagaaatattaggaccaactccacataatcctaaacatccagttcttaaaacttcaacttcattttcaagtccaagtgctttaatttctttttcaaattctgtaattagttcaccagaattaccgattgtacaaccagtcccggcacatactaatacttgggttctttttgctggcatcttacaacctcctatttcttataatgtccgaccgtatattcgtcgataatttcatcattttttagatgtcgaacagcaatctctttcgcttttttggcatcaactaagacataagttgttttgttgtcatcacggtcaaacacttctacgattggttctagtgtacacattccgatacagccagtctgtaatacagtagctggcagtttttgattggcaacttcttctactaatgtatttaaaactggtctagctccagctgctattccacaagttgccattccgacaacaactcgatatttttgtttatcatcactacgcattgccatattgtttttggcagcgtcacgtattttcattaaatcttctaaggatttcatttgtgtaatccctcctttatataattttttaaccagataataacttctggtagattgattgcgacaccatcaagaatctgttttatttctttagtgtctaaaatgaattcaaaatcatcacttgtatatttaaatagatagtcaattttatcatcagcttgaattaaagtaatgatagtgtcaacaagattacccattggtggggtatcgatatgatttttaacaaattcaccataaactgtagttccttcattaataaccgatttaattgaaaatttcccaccagtagcttcgatattttctttaaacatcggaattcctaaaccaactttgcgagtcgttcttgttgtatagaaaggatcaattactttgtttactgtttcttgatccataccacagccattatcgataatttgaatactaatgatatttaatttactactatcatgtataaaaattttaattaaattagctttggctttaattgagttataggcaatatcaagaatattcattgcaatttcctgcatttgttatttcctccataattgataaaacttatctttatcaatttgattgattggttcattgattgattctagattatgagcatcactattaaaaaatatataatcatctttaagatgtgggcataacacttttagttcttttaattctttaatactagtaacttcaattccatcgtaatctaaatcgctgggaatatcatgataaacttcatagatcccaaatttttttgccatgacatgagccaaaatggcaacaccatcaaattcatgaattttattgacgatttggtaaacatccaaatctaaagaactgatcaataaattattttcaacatcaatgatttcatcattactatcaaatatatattgatttccataataatcaggctgattagtaatttttatcatatgtttatcgatccatttttgaatgatcttcaaattagtatctttaaggaaataagctagaatatgaatttcttctttactttgtaattcgacaccgtgaacataatcgatctttccttttaaaatatcatgattgatgatttcttctaaataaaactgctgttttaaagaattatgatcagtaatagcaattagctctaatcctttgatataagccatattaaaaatattattaattgtcatcgtgtcatcactgcatggtgatagtgctgagtgaatatgcaaatcataatacattttatagacccaacgaaattaactctttagcaactaaaaaagcatctttttcactaatgaataatggaattttaagttctgtagctttcatgatcgtatcttcgtcaggataactatcttgaacaaaaataatgcctgcaaaatcatttaactgagcaacagcaattacattgatatgtttttgaaccgttaaccataaagaaccttctttaccattagccataacaaaacttaataaatcaccaatatatacactttcaacaatatttgttaagggaacactattgatttgttttatatttaatttcaatatttcttctatttccatttaatcaccttcttttgacccgacataaagaatcatcaacttcaccactagcaattcttgatgctagaccacgacagtttgcaaatccacaactgccacaatcaaattgcggtaatgtctctaagatagcattaaccttattaaaccatgctaagcgttctttaaaattcttttcatcactattaattgtgtgggtcttttgataatcggtcttttctagaatagcaacatctttatgacattggctaatcatgctttcgatattaaaacatccttcaaatggatttgaccaaagataataaccgccaatgcatccttgataacaattaaataaagcaatcaagtcagcatgttttagctggtcaaattcaattaaatctaaaacctttttaatttgtggtagaccttcaacactaattacagataaatctctattaccaaagagatcactgacaatgctttttaccccgtatttatttatttcgatgtctgattgttctttatctttaagcttattgatttgtggaaacatctgagagatgcttaaagcataatcgatatttgatgtttcattaccaaaaggatttttagctaaagttaattttccaacacattcacataatgaataaataccaatatttttatccttatatttagctcttaatttttttgcagcaatttcaattggataatcatatggtaataaatgatcaataagggtaggataatcatttttaattaatttattgatagtcgggcaaaaagacgtgagcataactttatgtttaccaacactatcttttaaagcttgtttatataatgttccttcaatatcactatattgaacaacttcatcaaaaccaaatttctttattgcatgagcaatatttttaatttcctgataagtttttaaatctgataaaattgctgttggaatcaaagcaatattataatcatatttttttaatgctttttgtaagtcaacttgtttaacttttaatactttctggtcacatgcctgaatacagatatcacaattaatacatttatctttatcgataattacttgttcattaacaattgaaatagcgtccatgggacatgttttaacgcatttaatgcaatttttacagctattgcctaaatagctgattaccggtttcattgaaaagtcattttgatatgtgttccttcacttgaagatgttatttcaaatgaagatgcaacacttttcatattgaaaagtcccattccagcaccaaatcccaattctctagctttaggagaagcagtagagtaacctggtgtttgggctagttcaagattttcgattcctggaccaatatcatcaaaagatagatgaacgataccttcatcatcaatttcaaaagtaaccgtaccaccattagaatgaatagcaatatttatttccgcttcataacaggcaatcgctacagcttttaaaaccttacgatctattcctaatgcttttaaagttcttttgatatcgctggaagcttttccggcatcctggtaattatctttttctacttgataagttttaatcatcgtcgcattcccgcttcgtataattttccgcaggcttcgaacatcatttcatcagtttggaaaagattgatatgcaaattttttgccatatcaacaattgtcatatctaaaggttttcctctgacaaaaagaattgtttcaatatctagaacttctgcggtacgtaatgactgcacatttgcaagaccagttataaataaaatgtcctccgtttcatttttcaacaatgctagggcatctgacattaaatcagtagaaaagcccttatcatagtttcggttataaatatctttatcgtcgatataaatttctttagcctttaaaatatcaacgatctctttaactaacatggggcttcttctttcaaataatctagaactaacatttttaaatcttctaattgtttagaacatccaaaaactgttccgtcaacactgactactggggcaagcccacaagcacctacacaacgtgttgcatcaattgaaaataagccatctggactagttgagtttacttcgcatcccgtcatttcacaaagtaaatctagaatagtttgggaaccattgacatagcaggctgttcctaaacaaacagagataatatgttttcctttaggttcagttgtaaattgtgagtaaaaggttacaactccataaacttttgatactggcacattaattgccgcagcaattttttccattgcttcaaatggaatatagccaagttcatcttgaacttcatgcagcatcaatttcattggaccttttttatctttatgtttttcaacaatttcgtcaattttatccaaatactcttgtttcaacttcttcatttttacacctctttctttttatcgtatgttataattataacatgttttgaaaccgctttaaatagcataaattataaaagtcccatatatttgacagttataataaatagacaaaaaagtatatatttagaataatcaaacacaatttactatttatatgttaaaataaattcataaggagaaagtaatatgatgaatttattacatttaaaatacgtaattgaagtggctaaagctggctcgataagtaaagctgccaataatctctatatgaatcaaccgcacttaagtaaaacgatcaaagatttagaagaaaatatgcaaataattatttttgaaagaacttctaaaggagttgttccaactaaaaaaggggctgaatttattgaacgagctaaaagcattattatgcaggttgatgaaatggaagcgatgtatcatagctatgatgataaatcgattcatttagatatatgtgtaccaagagctagttatattgcaaatgcatttactaattatttatcaatgataaatctgaaagataaaaatattaaagtaaattatcgtgaaactaattcttttgaaacgatcaaagaggtttatgaaggagatgcgaatattggaattattcgtttttttgaagatgaaaaaaattattttattaatttattaaagactaaagagctcgaatatgaagaaattcatcagtttaactatcaattgcttgtttcaaatgataatcctttagcttataaagaaaaaatcagtttaaatgatttaaataatcagattgaaattacgcacggggatatctcattaccttcactgcctttagtggcagcaaattgtaatgataaaacaagacaggctaaaaaacagataactatttatgaaagaggtattcagtttgaactgcttaaccgtctgcctcatacatacatgtgggtttcaccgattcctcaagaaattttgattcgttataatttaaaaacaaaaatttgtcaggataatagtactacttgttatgatttcttgatcaatcgtaaaggatatcgaatctctaaggaagaccagggatttatcaatgagataaaacatagttttaatagagatattatttaggtatacgaaaaaaggaatagggctattccttttttgtcacttcgaagttaaatttgtaagcgctataatcaaatagtggaggtgcttattaatgcaaagatttacattacctagagatttatatcatggaaaaggttctttagaagcattaaaaacttttgaaggtaaaaaagcaattgtttgtgtaggcggtggaagtatgaaacgtaatggttttctagatcgtgccgttgactatttaaaagaagcagggatggaagttaagttatttgaaggaattgaacctgacccatcagtagaaacagtaatgaaaggtgcagctgtaatggaagaatttcagcctgactggatcgttgccatgggtgggggttctccaatcgatgcagctaaagcaatgtggatcaaatacgaatatccagaaattacttttgaagaaatgtgtaaagtatttgggattcctaaattacgtcaaaaagcacatttttgtgcaattccttcaactagtggaactgctacggaagtaacggcattttcaatcattacagattacaataaaggggtaaaatatccaattgccgattttgaaattacacctgatgttgctatcgtagatcctgatttagcagaaacgatgccagttaaattagtagctcatacaggtatggatgcgatgactcatgcaattgaagcatatgtatctactgcaaactgtaactatactgatccgcttgcaattcatgcaattgaaatgattcaggcaaatttagttaaatcttataacggagatatggcatgtcgtgatgatatgcatgatgctcaatgtttagcgggacaagcgttttctaatgctttattaggaatcgttcattcaatggcacataagacaggtgcagcttttgttgatcaaggtggtcatatcattcatggggctgctaatgcgatgtatttacctaaagtaattgcatttaacgctaaagatgaaacagcaaaaaaacgttatggtgtaattgccgattatatgcatttaggtggaaatagtgatgatgaaaaagtagcattattgattgcatatttacgcaagatgaatgatgatttaaatattccacattcaatcaatcactatggagcagatggtctacctgctgaggtagggtttgtacctgaagatgttttcttagctcgagttgaaaatattgccgctctagcaattgaagatgcatgtacaggatcaaatccaagaattccaactcaagaagagatggtaaaattattaaaagcttgctattatgatagcgaaattgatttttaaattttaaaaactagacaaggaggcaagggaccttgtcttttttttatcttatgttaaaatgcttttgatagggaggtaaggaaatgagtttatatatcacaagacatggggaaactgattataatgttaaaaatttagtttgcggtattagtgatgctagattgactgaaaaaggaattgaacaagctaaaaagctagcagtgtcgttacagtcagtaaattatcgctatctctacgtttcaccgttacaaagagcagttgacacagcaaatttagctaatgttcgacaattagaaatgatcgttgaaccacgtatcattgaaattaattttggaaaatatgaaggaatacatcgtaaagatgaaggttttttaaataataaacataatttagcgtttcgttatccaggtggtgaatcatttattgaattgtgtaaacgagtctatgaatttcttgatgaaataaaaaatcaggcagttgataatgatgttttattagtttgtcatggtgcagtttgtcgggctgttcatagttattttaatgatatgaccaatgatgatatttttaattatcaaactgataattgtgaattattgaagtatgattattaattgaatattttgaaatatgattagaaagaatttgttgaagaatagaaataaggaagtgttggataataaatcaacgcttctttttttacttaaaatataaaagaatctgttacaagatacgtgttttatcatgatggctaaaagttaaaaaatgttgttattaacgataaaaacttgttgtaatttttgtaaaaaaaagttacaaatattctaactttatagtaaaaaagaggttatgataaaatattttatataaatacgttttgaaaggaggataggtctaaaaggataagatttattattgttactatgtttaaataatgagctattaaataaatttgtaaatgaaaaaagttaaacgtagtaatattggatgattaaaaaattaaggatttattgtgggaatgggatgttaataaataatatggtattaaaaaagaagggaagtggagaaataatgcagcacattaaaaaaatatttattatgatcgttagtgcttttttattaatgacatcgattacgagcggtattgtaacgatcaaagcacaagatgatgttgatcaatatgcgcttatgcgtgaaaaatttcacgatatggcggttggcggcagctatgatattaatgatccagatgtaaaaccgatgttacagtctattaatgatacagcacagttgtattgggataatatgaataaaaatcctatctctaatgcaataaaaggaaattatatgaatgctgaggatacggctttggatcctaatttagatccatcgaatgactatatttttcctgagtatccgctaggtaaacgccgtagtggcagcaatgcgtatattaatgcaaattcaattcaatttacatatcaatatcttagagctatggctttagcatatgagaccaaaggctgtgcattatataaaaatgaagatatgtttgaaagcattaaaatggcattagaattcatgaatgaatatcattataatcaagaattcaaacaaggcagtaaaacagtcccttatggtaactggttttcttggcgtttaggagctccggtttatttaggagaaacattacttcttttatatgatgatttggataaagagacgattgataaatacgctgcaacaatggcggaatttgttaactggacatcttttacaggagcaaattcaacatggaatgaacgtgtgagtatgtatactggtttattaacagaagattcatcatatatgagtcatattcaatcagtaatgccaacggtattaaaatatacagagcagggtgatggatctttccctgacggttactatgaagatggaacatttattcagcatacaacttttccttataatggtggatatggattgatgtgtctaacagatacagcatatttaatatacatgctttcaggaacagattgggatctaggagaagatagtgcgaatattgtatatgactgggtcttagattcatatgaaccaatggtttataatggtttaagtatggatgcttttcgtggtagagaaattacaagaactgatactacgcagcctcgtggggcattgatcattgcaaatgcgatgttaatgttatgtcaaaatgcgccagaaaatattcaaaatcaatttaaaggctgtatcaaacagtggtttagcaatgaatttatgattgaacaaatgaatgctagtgctgataccccttggtataaattcccattagatacagtagttaaagtaaataatattttagatgataataatatcatgccaataagttttgatggaacgacttatcaaatgaataatggtgctcggacgatccattggtcaaaagagggctgggcttatacgattgccatggcttcaccaactattaaaacttatgaaggtggcgattctaataataaaggatggtatattggaaatggtgctacttacttatatacaaatgatctagaacgtagcgaaggagtcgaaaaggcaaccaaagattggtatcgcattcctggggcaacttcagtatatggcagaaatcaaggatcacaatataatctcaatgcctttgctggtggtgtaagtgatggtgtatatggtgtatcagggatggatctagctatgacaactcataatttaaaagctaaaaagtcatggtttatgtttgatgatgaagttgttgctttaggaagcaatattagtggacaatatgatgtagaaacaacacttgaaaattataaaattgatgatcacaatagaacatattatgtagatggtaatgagcagacaatgagcatggatggtatagaaactgcttatagtaatgtaaaaacatttaatatgcaagggaatgttgaagattctgaaatcggattttatttccctaatagtttagacatcaatgtaaaaagtgaaactagatcaggaacatggtcatctttaggagaatataatcgcgatacgacgacatataatgccgattattttactgtttggacagatcatagtgaaaatggaaatggcgctgctgatggatcatatgcatatgtattattaccaggaaaatcagtcagtgaaaccgctgcatatgcttcaaatagtgatattgaaattattcgtcaagatgataaagtgcatgcagtatatgaaaagagtttaggaacattaggtgttaatttttggcaggatggatataattcagttgatttaggtgatgttaaaaattatgtaacaagtgatagcgcggcctcagttatgatcaatgatactgataatggcttgaatgtttctgttaccgatacgactcaacaaaataatgattatataactttagaaattaatcgtgaggtacagggattagttagtgctgatgaaggcattgaagttatccaaatggcaccaacgacgattattaaagttaatgttaaaaatgcagatggtaaatgtttccaggttgctttttcacatgatgatgtggatttaaaaccgacttcaatcactgatatttatatggatgatgatgctttagtagtagctgtaaatcgtgaaataaatgctaaaagctatttgattcactatggtaatgaaagtggtaaatatacaaatgttttagaaactgatgatttaacaacacggatctatggattaacaccaggggctacttattatttgaatgttcaagctaaaaatggtgaaaatattagtgaattcggaagcgaagtttcttttacgtcaactgctacaacttcattttttgatgaatttgaaacaatggataagatgttgagtcatacatcaaattgggattttgattcagcgaatgcgggacaaaatggacaggcgaataattttgaaagtgatactactcgaattaaacgcgttggttcagatagaaatagtgttgagtcgatcgtttatatgctgccaggacttcaagattttacattagaagtatatggttatgataattcgatcggaacgatcaacatgtatacatcacaggatggtaatacatggcaagaacaagcttatcgtacttcgccagctgtcaatactaaaaatggctggtttaaacaaaatttatcgacaccagagagtggaattaatgaagatgctaattatcttaaaattgaggtttgtgatcatccaactaaagtatgggcaccacaatttactagatttgatgctacgatgaaaaatgctagtgatcttaaattattaaaagatttaatgcaaaatgacagtaaaatatatttaactactgatgttgattttacaacttatttagatgatgatgtcgtaatggctaccagtgatgatgctgaattgttatatagttatacaaatattaaagatggtacgatcacagcttacgttaaagaaggtggcaatgtagatatttcgatatcaaataatggtatagattataccccattaactgttgcaaaagaggcagtagatactaatgatggttatacaaaaataaatattattattccagaattagcagaaaatatcgattatttaaaaataacaccatcaaaagatagtatgatttcagatgttactttgagttatgtgcctgaaaatgctgatgtccagcaaattcgatttgttgataaaagtatcgatggagttattgattatgatgtagttccagcagttaaaacagcaccaatgaatgcccaaagtacgcttatttataattcaaataatgatagtgttgttacatttaaaaatggtacattacagtttatgaaacaaggtagtgctacagttgagctgcaagtcaagggaactgatgtatcagctgttttaccagtcacagtatataaagatatggctttaaaaaaggcagtaacagcaagttcttcaacagctggttatgcagttactaatgctgttgatggtgatatggatattgcaagatggcaatctaattcgcaaggaaaagaatggattcaggtagatttaaaaaaagaaacatcttttgatgcgattgatcttaaatggtattcaaatggtgaaagttatgatattttggtttctaatgatggaacaaattggaagaatattaaatcagaaacagaagctaaatatggtcagtacgttcgttatgattttgatgaatcagtaacggcacgttatgtaaagattcaaggtgtaagcgaatcacaatattcattatttgcttttagagttctacaaagaacgggaagtgaaaatgatgttgaattagaaccatggaatctagcgcttaataaaccagcctatagtagtggtttacatccaagtgatggaactggaaaagctgaaaaatatgctgtagatggaagtactgcaacccgctgggcttcaagaagaacaaatgatgaatggttttatgtagatttagaatcagattgtattattcaagcagtcaatatattatgggaagttgcttcagcaaaagagtttaaattacaaatatctgaggatggtgaaacttggatcgacatggcccatattagtaataatagtgtgcaaaatgattggacaaaacatgtattttctcaagattatgttggtagatatgtccggatgcagggaattttagctaataccggatatggatattctatttatgaattccaggtaatgggaacaacagttgataatcctagtgttcaagatatcaataatatctcatttgtagataataaaatgagcatgttgaagggacaaacaacgactcttgtaattacaactgatcctgaaaatgtaacggcttctagtattgcctgggagtcatcaaatccaagcttagtatctgtcaacaataatggtaagattacgatcaaaggtgaatcaggaaaggcaataataacggcatattcgattaaagatccgactgttaaagctgaatgtacgatcaatattacacctagtgccggaaaagtaattaaagttgaaggtttatctttattgaatacggtcgatacattatttttaggagatattcatcaattaagtgcaaatattacgccagaaaatgcaacacatcaatatattatctggtcaagcagtgatgaatcagttattaaaatagatgctgatggaaaattaagtgctgttggaatgggaatagctacaattagtgctaagacaacagcaggagtaaatgttgaaataacgattacagttaaagaagctcaagttgataaagattcattacaagaaatttatgataaaaataaagataaagtaagtgaaacttatactcctgcaagctggcaaggattcagtgaagcaatggaacaggcaaaaaatgttttagaaaacgaaagtgttagtcaagaagaagttgatcaagttttagctgatttgatgactgctgttgaaggattagtgaaaaaagctgataaacgcggattagaaatagctgttgaagtagctgataaaattactgatgaagatttagaagcagtagttcctgctgtagtaaacgaatttaaagcagctttacaagaagctaaagcaatcttagaagatgaaaatgttagtcaagaaacagtaaatgcatcatttgatcgcttagcaacagcaattcaaatgttggattttattaaaggcgataaagcattattagagattttagtagctcaagcagctaaattagatagtagtgattatactgatgaatcatgggctgttgtagctgatgcgctagctaaagctaatgaagtacttgctgatgaaaatgcattgcaggatgaagtagatgcagcaacaaatgctttacaaaatgctataacaggattagtggaaaaagtagataagacattattagaagctttctacaataaagtaaaagatagtgaagaaagtaaatatttagcatcatcatggtcaggattcaaagaagctttaaatagtgctaaaaatgtattagaaaatgatgaagcaactcaagaacaagtggatgctgcatataatgtgctagttaaagcctatttagatttaagactaaaaccaaataaagatttattacaagaactaattgatcaagcaaaacgattagatcgagcaaattatagtttggctagttataaggtgatgttagaaacattatcagatgctcaagcaatatacgctaatgaagaagcaacagaagctgaggtaatagcagttcaaaatgatctagcaaaagcaatcgacagtttaatagaacaaagtaatgaagatacattaagtattaaaactggtgatgatagttttgtatatggttcattaggatcaatgatgctaatggcagtgacgattgttttattgaaaaaaagagaatcttagatcaaaattataaataaggaagttttaagaataagcttaattcttccttttttgttattttaaagtgctaaagaaacaatgttatagtagaaagattattaagttttagtttgtttaataaagtctaagatttataattttattaatcagataaccatagaaatattaagagatagatataatggaactaaagaatcatgaatagctataattaaaactataataaaaaaatttcataatttttttaaaagatacagaaatagcacatttttgacatttataaatagaagacttataataaaattaaataaataaacggggagcatttgctgagagtaagctttagacttagacccataacctgatttggataatgccaacgtagggaaacagtaattttgattgtttgcagaaggttctttcaggtgcctctgtttttttattaaaggaggacggaaattgaattatacaacacagatggatgcagcgagaaaaggaatgataacaccagaaatgaaaattgttgctgccaaagaaaaccttgatattgagttattaagagaaaagatggctttaggagaagttattatcccatgcaacaaagttcatcatgctctttgccccaatggaatcggagctatgttaaaaacaaaaatcaatgtgaatttaggaacttcaagagatttagttgatttagagatggaatatgaaaaagtagatatggcagtaaagatgggggcagaagccattatggatttgagttcttttggggatacgcaaaagtttagaaaatttttagtcgaaaaatgtccagcaatgctaggaacagtacctatttatgatgccgtagtttattatcataaaccacttatgcagattacaagtaaagaatggatcgatattgtaagaatgcatgctcaagacggtgtagattttatgacgattcattgtggaatcaatcgaaatactgctaaacgttttaaagaaaataaacgtttaatgaatattgtttctcgtggcggttcgattatttttgcctggatggaaatgacaggaaaagaaaatcctttctatgaatattttgatgaaattttagatatttgtgaacaatatgatgtgactttgagtttgggtgatgcctgtcgaccaggctgtatcgaagatgccagtgatgctagtcaaattgaagaattaattgttttgggggagttgacaaaacgggcttggcagaaaaatgtccaagttatgattgaagggccaggacatatgccgcttaatcaaattcaagcgaatatggaaattcaaaaaacattgtgtcatggcgctccattttatgtcttgggaccaatcgtaacagatatagcacctggttatgatcatattaccagtgcaatcggtggggcagtagcagcagccaatggtgcttcatttttatgctatgtgacaccagcagaacatttaagattacctgatataaatgatgttaaagaaggaataattgctagtaaaatagcggctcatgcagctgatattgctaaaggaattccccatgcgatggatattgatcgtcaaatgagtgaagcaagaaaaaaactagattgggaaaaaatgttcacattggcaatcgatcctgataaagctatagcctaccgtcaatcttcaaaaccagaaaaagaagatacatgcagtatgtgtgggaatttttgtgcagtaaaaaatatgaatagaatattagatggagaaaatatttctatatttgatgaataggagaaaattatgtttaaagaaatgttagataatgtcagaataaaaaaaccacttatccataatattacgaattatgtaacagtgaatgatgtagcaaatatggtcttagcttgtggggcaagtcctatcatggcagatgatgaaaatgaagtagcagaaattaccagtatttgtacaggattgaatattaatattggaacattaaattctagaacgattttatctatgaaaaaagcgggacagaaagcaaatgaattgtcacatccggttttattggatccagtcggcgtaggagcaagtcagcttagaacaaagacagcttttgaattgatcgataatgtttcttttagtgttattagaggaaacatttctgaaatcaaagttttagcttatcgccaaggaagtgttcatggcgttgatgcaaatgtcgaggacgctgtcaatgaagaaaatttagataattgtattgcatttgttaaaaaatttgctcagcaggttcaagcggtagttgcggtgacaggagcaatagatttagttagtgatggaacaacttgctatgttattagaaacggaacaaaggaaatgagtgctataacggggacgggctgtcagctgtcagctttaacaacagcttttatttgtgctaatcaagattatattttagaagcaacagcagcagctgtttgtacaatgggattagccggtgaaattgcccaaacaaagatgcaagatcatgaagggaatgcaacttatcgaaatcgaattattgatgctgtttatcacatgacgggtgatgttttagcaaaaggagcaaaatatgaaattagataagcaggatttattattatatgctgtaactgatcgcagctggttgaaagatagatcccttgccagtcaggtagaagatgctttaaaaggcggagcaacatttttacagcttagagaaaaagatttagacgatgaaacttttaaagatgaggcattgcagatcaaagcgttatgccaaaaatatcatgtaccatttattattaacgataatgttgaattggctaaggaaattgatgctgatggtgtacatataggacaagatgattgtgaattgaaaaaagcaagagaaattttaggtaaggataagatcattggtgtttcggttcatgatttaaaagaagcaagaatagcttatgaaaatggtgcagattatttaggtgtaggtgcagttttttcaactaatactaaaaaggatgcttcagcggtttcgtttacaactttaaaagaaatttgtacaaatatagatatacctgttgtagctattggcggtattaatgctgataatattattcaattaacaggtagtgggatagatggagtggctgtgattagtgcaatttttgcccaagatgatataaaagaagcagcaaaaaaactaaaagaaaagatcagtcgattagttcatcaaacaataccggcttgtttaacgattgcgggaagtgatagcagtggtggtgctggtattcaggctgatgtgaaaacaatgctgataaatcgggtttatgctatgtccgctttaacagctttaacagcacaaaatacgactggtgttacgggtatttatgaggtatcagatgaatttttagagcaacagttagatagcatttttacagatatttatcccgaagctgtaaaaattggcatggtgtcaaatcaagctttgattatttcgattgcaaagaagttaaaagagtataatgctcgaaatatcgttattgatcccgttatgatagcgagcagcggtgctaaattgatcgatgatgaagcaattgatactttaaaagaatatttgttacctatggctactgttttaacaccgaacattcctgaagcagaaattttagcagatatgaaaattaaaaacgaaccggaaatggtggaagctgctgctttaattggtgaaaaatacggctgtgcagttttgatcaaaggtggtcatgctattaatgatgctaatgatttgttgtatcaaaaaggacattatcaatggtttaaagaaaaacggatcgataatttcaatactcatggcaccggttgtactttatcaagcgcaatagcagcaaacttagcaaaaggggatagtttagaaaaatctatagaaaaagcaaaaaaatatatatcaaaagcattagcagcgatgctcgatctaggaagtggttcgggaccaatggatcatggctgggtattagataaatgattgttgctaatgcatatatatttgttattgatgcggtaaaaaatgcacattaatgagtataatgatgtaaaaattcttatagctgatggaaagtatacataagataatgaagtatgatggtgtttttaaatttcttgaaattcggagatgatttaataataagtcattgacaaggtaggttgtgaaaaatagcctaccttgttagttaaggggataaaatttgaatcataatttgcaattatacagatatttagtattattttgtttgttaaaagataatattggtttgtctaatcaagataacgatatccaagtatagaaaatttattatatattaatttaataatgatttttatcatagttaatgttataatacctaagaataatttatggaggcaaatatgaatattattgaattaatcaaagttataattttaggtgtggtagaagggattacagaatggctgccaattagtagcactggacatatgattttggtggatgagtttataaaattagatgttagtgctgattttttagagatgtttttagttgtaatccaattaggagcaatacttgctgttgtgtttttgtactggcaaaagttacttccgtttgattataaaaataattggaaaataaaaaaagatacattttcaatgtggttcaaaataattgcagcttgtattcctgcggcagtagtaggggtattatttgatgatcaattaaatgaattattttataatcctccaactgttgctattgctttaattgtttttgggattttatttattattatagaaaattataataaaggaaaaaaagcaaaaatcaattcattaagtgaaataacttataatacagcattgattataggaatatttcaattaattgcagcaatttttcctggtacttctcgttctggagcaactattgttggagctttgttgattggagttagtcgtacagtagctgctgaatttactttctttttagcagtaccagtcatgtttggagcaagtttattaaaattagttaaatttggattcgcttttactgccagtgaattagttttattgattattggtatgttagtagcttttgttgtcagtatgataacgatcaagtttttaatgagttatattaaaaaacatgattttaaagtgtttggctggtatcgaattattttaggaattattgttttgatttattttatgattttctaagtaaagtacacatataaattttatatgtgtatttttttagctaaaaaaatcgttttatgcataacttaggatgaggtgttgatattgtgtggttatgatattttgtatttagataatgatactgaaagtaaaaaagattaccttgataaaattgaaaaataattactgaaggtaagaaaaataataatgtttcaataaaagcaaaatattaaagaaatcgattatttaagaaataataaagggatcatattataaaatatctttatttatgttacaatgataaaagagtaaaggaaaatgttgatctgaaaaaatttctattttaatagttataagattcgtgatgtttaacttttaagataaaaatatcttgtgctaataatatctttataaaaatcaagcaaagctgcggcttataagttattttgattaagaaatttttttggaaaaagcaaaaataatagcttgcaatacttaatagtttgaaaagaaatgtaggcagaaaggagagatagcgattatgaagattttattatgctgcatggcaggggttacttctaatatgtttgcatcagcattaaaggatgaagcagctaaaagagatttggaaattattgtctgggctgcggctcaaacagcagttgaatattctattgaacaagctgatttgattttagtaacgccacaactagcaggttcattaaagaaatttaaagatctagcagtaccaggaacgccagtaagtcttattagtgaagaagattttagaacttttaatgctaaaaaggttttagatgatgttctttcgttataatgataaaaaataagaactatagctgatttgatagtatgatataaaataacctcatcattatgatgaggttattctttatgagcaagttcgatccagtaatctgataatttctctaacatttttaaaaattctgttgtctcttctttggaaaaaacactaaacatatcatcagtcatattttgtgtaatatgaccactatcagctgcttttatagcatgatgtaaatatttcataataagctgatgttcacgctgtttaaaatgcagtcgtttgtcatgttgtttaggcatttgagggataaccccagttttggcatatgtttttcctctagggcaatgtggttttgataaatcacattgtctaggacatatcggacaatgtgtttctttcatacttttactagatatttaaagcagattctaaatctttaagcatcatatctaatgctgtgataccaccttcagcagtataccaaacagctggatgttctaagtagatgatttgattattttgatatgcatttgtttttgcaaccaattcattttccatgatatcttttgctaattgagcaccatcagtaccaattgcagcatctctatccataacaaagatataatcaggatttaattgtaaaactaattcaaatgatgtttcattaccatgagttggagtagttccagatgttgaattatcagatgatccatcactattactattgccacgtccgccacgagtactattttcactagaggcagcagttgccgcttcaacaccaatattttcaaatccaatttcattaggaatcaatgaacaacgaccatcattacctaataaattaaaacttccacttgttgtcataccaagtaaagctgtttttccttcagcaaactcagcaagtttttcgattcgtgaattgaaaacatcgattttttcatctacttcatcttctaatccaaaaatagaagcaattattttggcattattacttacacttttaactagtccagcttctgtatcagttgctaaaaatacaactggagctatttcacttaaatcatcataagaagcacttaaacgcccaccaataaaaataatatctggttcacattccataactgcttccatatctgcttctttgattgttcctaaatttacaatatcatcattatttacataatcttgtaaataatctaaagatgttgtagatgaaccaacgacactatcacctagatctaaattatctaaaatatctaaaacagccatatctaaaacagcaattctttcaggatcgtatgggacttcaacttcacattcttttttattaccgtctaatgcagtaattgttacagtttctttttcttcttctttttcattatttgatgagcagccagttattccaactgctaatactaatactagaattaatgataataattttttcatattttcctccaaattttaataataaatcgttaatggttttccatcaatttccataatttcaaaatctacattatatatttttgacagtgtttctttagtaattacttctttaactgttccaaattttgcaaccttagcatcttttaatgcacaaatataatcagaataaaaggctgcataattaatttcatgaagaacaagaataattgtttttcctagatcatcacagagtcttcgaacaattttcatcatatttgttgcatggtaaatatcaagattgtttgttggttcgtcaaataaaatgtattctgtatcttgagcaataaccattgcaatataagctctttgacgttgtccccctgataattcatcaataaattgatcttcaaattcttctaattccatataactaatagcttgatcgatcatttcttcatcttcctttgtaagatgactgcctgaataagggaagcgtccaaatgatacaagttctcgcactgttaatttcatttgtacattatttgtctgtgttaaaatagctaaacgtttagaaagctctttacttttccagtctttaatatctttaccttgaaattcaatttcaccactatctcttgctattaaacgcgaaatcatatttaaaatcgttgattttcctgcaccgttaggtccaatcatagatgtaacacattttttaggaatatcaaagcttacttcatcgactactttttttccatcgtatttttttgttaatttttttattttcaaatttatacactcctgttcgttaatagtaaataaagaaaataaataccaccggcaactgagataaagacgcttacagggatagcataactatatacccgttcaacgattatttgtccgccaataagaacgaacattccgaaaaatgttgcccctaaaattaattgactatgctgataagttttaaataattgccgtgataaattggcaagaattaatcccaaaaatgaaattggtccaaccattgctgttgcaatagcaatacatagagttacacctaatagcaatcttttgatactacggtcgtaatcgacacctaagttaatagcttgatcttttcccagtgtcaatacatctagtaattttaaatccttccataaaaaataaattaaaatgattaatagaatgattgaaaaaattataatttcagtattgatattgttaaaacttgctactaaagatgccagtaaattatcatattcattaggatccattattcgtgtcaaagttgtttgaatacttgaaaagaatgaagttaatacagttccaatcaataaaacatatagaatattatattttgtctttttaaataaatagctataaattatggttgctacaagtgccataattattagatcagcagcaaatgaataattagcattgattgctaaaagacttgttgaaccagcaataaaaataattgctgtatgtattaaagaatataaagcattcatacctagtaaacagggggtaacgatacgattattgataattgattggaatacaatagatgcaccaccaattgaaaatgagacaataatcataacaataactttaggaatacgaattttcatagaatacatgaaaagttttggatttgaaaacttaacgccaataaacaaatatcctataattgcaagaacagttagaattcctaaacaaataaacttttttttctgaattttgtttaaagaaaatctcattttgttcctcctttttttaagcaaatagctttacgaccatgctgtaaacgataaaataataagaagataaagagaatacttcctaatattccaataattagttcaataggaagttcataagggaaaataataactcttcctatcatatcacagactaaaacaaaaattgcaccaaataatgctgtatcaatcattgtgcctcgaattttatcacctttaaacattgcaaccaaattaggaacaatcaagccaatatatgaaattgatccaacaataactacgatacttgcagtaattgttgctgctatgatcaatcctaaaaataatatcacgtggtaattgacacctagattttttgaaaaatcttttcccataccaacgatattaaaatgatttgcatatataaaagcaataataaccaaaggaactactaagtaaacaatttcataacgccctcgtaaaacaagtgaaaaatgtccaactaaccatgttgataatgcttgagtcatttcgtatttatatgcaaaatagtttgtgataccattaataacattactaaacataattcctactagaggtaccattacgacatctttaaattgaattctttgaatgaatccgacaaaaatacatgttcctaatattgcgaatataaatgcaaaaaatgctcttgaccataatgttgaagcgggcataaaaagtagtgctaataaaatcccgaattgggctgaagaaattgttgctcctgtagttggagaaacaaatttattcatacataattgctgcatgatcaatccagcaacactcattcctataccagtacataaaattgcaagtaaacgtggtaaccgtgaaattaagaagatttctaattgttctaaattaccagataaaacagatccaatatttaaatctattacaccaacaaataatgatattcctgataataggatcaatatgataaaaaggcatattgttgaataatattttttaatgataaattcctcctctcttattggttgaagcagcagtgcgtcagcattataatgttagattaatctaacattatagcaacaaaaaaacaacgtttgcagcaaactggttttacatgccaagcactacacgttgctctaatatagtagcataacaaatttatagaagtcaacattatttatctaattaaataaaaaatttgttactattcattgaaaagcaacaaattatgcatgaattttggtatattatatgcaagtctttaataaaatatatataatagaaagaattgtagttgttgataattttgaaaaaatacatttcatgatatacgattgtaagattagaaattttttaatgcatgagatgagaaattaaggaggggtgaaaaatgaataaagtgatttttattttttcgattttcttttttaaaagaagtaagtagtattataaatagggttactagcaatgtttgtaattcagttaaaatcaataactaaagctgatagctatagctttagattggaaaattataggaaatgatgtacaagagatattagaagtacagaatataaacaaaacaaaaaagcaagttagaaaggtgaatgatttaggtaataaggtcatagaaaaggataatgaaatagaatatggctattaaacaataaatgaattatcagaagaaaagagaacatttttaacatatcagatcatgggcacttatattgcattctagtaatttttaacaataatttggttttataattgcgttaatctttattatttgggttttgtattgatagtgttagataaaaatataacaggttattattgaaatattattacttttgtaggggtattgacgattgaagaaatgatataagacaatgaaaaaaatattgaatagtattttgttagaaataagactaactgtttgtacgttgcttttcaagaacgaatatatagctaggctataatcacctattttttttgtatctttttaaattacgcaaaatttgttcctgtttaaccttcttacgttcataaaaggctatttgttcgtctttgttaggtatgttactgttacgtagtatttttaatattctatcacattttcttaaattatttaccgcttctatttgttttctatttttcaaaatatcacctttataaaatctttgacaatttttatatttataatcctcatagatctacataaattgagcggaatatactgttattttagtgtggaaggaaaaatatgaagagacgaatagaaaataatttaaattataagaaatattttaaataaaaagtttgttcgtcagtgctgatagattcatactgtatcttttaagcatgattaagatataataataggttaagacattatgaagatcacccagtaactaggatgttttttagataagattaagaaatatatttttgtgtgcataattgtcattttgtaaaagaatgcaactttgtttcataaggttgcaacccaattaatagaaattacaaccaattcaacagttatgagctgatagtggtattttccctatatgtaaaaatcttaacttttcttaactattttatcttttatgggtgcatttttttgtacgcatactttttagtttttatacaagctgtttctatagaacatggtaaaggcactatttaaatgttttcaaaagaaaaagaaacctatttatagatttctcttctgtgaccaacgttaataacaagtataataagtttatcatcttctatctcacataaaatacgataatctcccactctatatctccattgattttttaaattaccttttaatgcttttccaagaatacggggatcttcacaattacctagatttttttcaatccaatttactagcattaactttgtgtagttatccattttcttgagctgttttaatgcagttttagaaaaaacaacatcatatctcataatcctaattccttttttacttcatccatagaataagtagttgaattatttaaatattctttatgtgcttgttctgctaatgcaacatcatattcatcttcaattttttcaagtaaagctttttttaaagcttcacctaaagaacatccatgaaaacttgcataacttctaaataatttttcttcttcatcattcaatctaattgagaaactcatatagttcaccctcttttcgtaatacattgtactacatcaactaacgtatgtcaatatgttaatatagtttccttgtaacttaaatatataaagattttccttctacataaaaaacataacacttagaatattctatgttttctatccgttggtaaagtgaaaaaacagatagatgaaacatgtggacgatttttcaacattcaataaagaaaacatttctaaagaaagaatctgaagtacaaagtatatggaatatgatgaatgaggtatgataaaagccgtagacagaacagaaagaaaatatttgtcgttataacagtacataattggtacttcaaacaactgattatgtactagagacatagtgtctctgaaaatactttatatttgaaactttacagctgatattgttatgcaaatgttggttatcaaattatgttagataacttttttagattaaattatttgtttttgaaatgcttttttataaattaattataataatcaaattattttaactgttttattatatttattaatttgattttgtattttttacttaaaataacaggataatcaacattataaactcttcgaccagatttttatatcattttatataattttgatcaatagtaagtaatatttcctttttcatttatccaatctttcataaaaataaaaatcctctaaataataactaaagcgctgaatcctttagaacatattcggtggggcgattgttctcacatctcatcgagttacctctacactttacatattgttatgcgcgatagccatctttttatcctcgaacatgccctatttagttgtaataatgcagaagattaaattatcttcatgtattagtatatgtaagaataaagtagtttatgctttataaatacataaattattttctacgatatttcttttaataccaatactttaaaatatatgataacacatacgagtatcacatatagtgatattgggtgatttgatttctaattactaaaattatttgtgttttgtttctgtatccgtacttttatgggtatctacaataatatcatcatgaaggtgaccaccatgtctaaacatatcaagattactaagtcaaaacattctgaatcttacaatattgttgatgattatacataaactttaatttccatattccaagacatccatttgctacaacattggtgatgaatgatgttgatattaagactacacaagaattaatgcgacatagtgattttaatatcactatgacactatacactcacattagtaaagaacataaagctaaagtgataaatgatgtttttggattaaaaagtttcgaaaattaatgacgaaataaaaacccttaactaatttggctctaggtcaagggttttaggaaatttaaaatctcattactatttatattggcatcctcagtaggaatcgaacctacaacttaacctccggagggttacgtgatatccatttcactatgaggacagtacttgataagtataacactattaaatctaaaaataaatatcaaaaaaagatttttgaaaaaaagtttgactataaatataaaataactgactaggcagataaaagatccagatcataatagcaaaaacagaatcgataagttttagatatacaagcgcaataataatatcacaacataataaaagaaaaacagcaataaaaagctttttataaattttaaaactatgatatagattcaataaactaaaacctaaatatataagtgccaaactaactaaagggtttattaaaataagacctaaaaaaacaaaaggaaaataattagcatattttatcagatacatatacgtcaattgaaccataataaataaactaataccaattaaataatgatttgtaaataacaaaaaataatcagcgataaatgctaaagcactagctaaaatagcaggtggactaactttttttataactagataaataaaacaattaaaactgatcaaccatttgatcagattactatcgatatgataaatatcacaatatacaaatattcctccaaggatgatattaataatatagatcatctaatcacctcttaaataaattattacgatttaattcacatttatgcttttttaattaaataaattctgataaataactaataaaatatagcttatataaggggaaatttgttaaaatgaagaaggtgatatttctatggaacaaaagcatatttttataataaaaccaaatacacaaagtcctaaaatagaagcgatgatcaattctttgatgaaaggatatgactatgaaataaaatatacaaaatattcgcgccatgcgacagaaattgcaaaaagctatcaaaaatataatcatcgtatttatgcagttggcggagatggcatagttcatgaaattgttcagggattgattggcagtgataatgaactagttattattcctgctggaacaggaaatgattttatgcggacgattgctaataccaatgatccctatgagcttttagaaatgtcattacatttaaaggctcagccaattgatttgatcaaagctaacgatatctattgtattaatgtgttttgctgtgcttttgatagtgatatagctaataatgttcataattatcgccgaatcaaatatttaccaaaagctttgcagtatgcaaatgttttagttagaagaatgtcaaaatatcgtttatatcccacgactctttatcaaaatgaaaaaaagatttatgaaggaagtttaattgttggggcattttgcaatggtaagtattttggcggtggatttaaaataggtaaaaatgctaatattcaagatggtttgatcgatattaacttagtttctagtttaaagaaaagatcaattccatactatttgtttttattatttacaggtcagttggaaaaaggaaagttatattatcataataagttaaaagtattagatattaaaacaaatcaggatgttaatatcgatggagaaaggtattctaaaggctgttatcatttagaaattgttaagaattcgttaaaagttgtattatataaataaaaggattgactttttttgtcaatctagttatcatataggaacataaaagggagtagctaacacatagtgtttacgctttcgtcaatacgatgatctagtcatccggaacgtaatgaaatagcgagacttttattgcatttttagtatgcaataaagggactcgcttttattgtatacgaataggagggaaatagatgaaagcatattacaacaaatcaatatctgaaattagaaaagaaatcaatggctcattaaaaccgctcaatgatgaacaagtcaaaagaaatcaagaaaaatatggtttaaatgaactaattgaaactaaaccaaaaagtataccgatgatttttatcgagcagtttcaagattttttagtcattatacttatcatggcagccttagtgtctggctttttaggagattttgaaagtgctttagtaattttgatcgtaattacaatcaatgcagtcttggggacagtccaaactgtgaaagcaaatcaatcattagatagtcttaaagaattatcagcacctaatgctaaagtgttacgcaataataaaattatcgaaattcctagtaaagaggtaactataggggatgaagtttacttagaagctggtgattatataccggctgatggaagaattattgaaaataaaagtatgaaggttgatgaaagtgctttaactggagaaagtttggcagtagaaaaagcgacagctgttattgaaggcgaagtacctttaggcgatcgtgttaatatggtgtattctggaagttttgtgacttatggtcgtggcagttttttagttacggaaatagcgatggaaacagaagtagggaaaattgcacaattattaaaaagtacttctgataaaaaaacacctttacagatgaatttagataattttggtaaaaaattatcaattatcattatggcattttgtgcgttattatttgttttaaacatcttacaaggtggtaatattggtaacgcttttatgtttgcaatagcattagcggtagccgccattcctgaagctttgagttcgatcgtaacgatcgtactatctttcggaacgcaaaaaatggctaaagaaggggcgattattcgtaagctgcaagccgtagagggcttaggtagtgtttctgttatttgttcagataaaacaggaaccttaactcaaaataaaatgacagtcgaagattattatattgaagaaaaaaggattttagctaaagatattgatccttctaatccattgcataaagatctaatgcgtttaagtattttgtgtaacgattctacaaatactgatggtcaagaaataggtgatcctacggaaacagcactgatcaatcttagtgatagtttaaatgtaccagctaaacgagttagagatgcttatccacgcttaagtgaattaccttttgatagtgatcgtaaaatgatgtcaactctgcatcttttaaaagatggttacacaatgattactaaaggagcagttgatgttttaatcaaaagagttaaatatattcgtaaaaatggtcaaattttagaaatcaccgaagatgatatcaagaaaattagtgccacgaatatggaattttctaaaaacggattgcgcgttttagcgatcacttatcgtaaatttgatcaagagaaagttttgatgcttgaagatgaaaatgatttgatcttcctaggtctaatttctatgatggatccgccacgagtagaaagtgctaaagcagttgaagaatgtattcaagcgggaattattccaattatgattactggtgatcataaaatcacagcgatggctattgctagaagaatcggaattttaactgatgattcgcaagcagttgagggaagtatgatcgattatttaactgatgaacagttaaaacagtttgttgcagataaacgcgtttatgcgcgagtttcaccagaacataagattcgaattgttaaagcatggcaggaaagaggaaatattgtagcgatgactggtgatggtgtcaatgatgctccggctttaaaacaagcaaatattggtgttgcgatgggaatcacaggtagtgaagtatctaaggatgctgcggcgatggttttgactgatgataattttgcaacaatcgtcaaagctattgaaaatggacgaaatgtttatagtcatattaaagatgcaattcaatttttattgtcaggaaattttggcggaatcctagctgttttatatgcttcgatcatggctttaccagtaccgtttgcgccagtacatttattatttattaatttacttactgatagtttaccagcgattgctttaggactggaacctcacagtaaagaagttatgaaagaaaaaccaagaccgatgaatgaatcaattttaactaaacagtttttaattgatgtgggaattgagggctttgtgattgctttaatgacaatgctggcatttacgattggatatcaagatggtaataccgtattagctagtaccatggcttttgcaacgctttgtttatcaagattagtacatggttataattgtaagtcaaagaaaccagttatctttaaaaaaggttttttcaataatatatttttacaaggagcttttttgattggttttattctgattactttagttgttacaatgccatttttacaaacagtatttaaagttcaaacattaaacattgaacaattaatgattgtttacggtttagcactagctaatttaccaattattcaaataattaaaaaaattaaaaatagctaaataatcaacaaaagttgattaagaaaagttgaaaacaacttttcttttttttgtaacctttataatatatttgttgtctatatagtgaatcgattcaaagaggaggtatcaatttgaagaataatgttgaattaaacattgatttgattattgaagaatacagtcattatgtatttactgttatttataatatggctggagatagcttatcttatcatgatatagaagaaattattgctgatacattttatcttttctggaagaatcaaaataagattcaaacgaatatgaaatcatatttgtcaacgattgctagaaactgtacttataatagattaaaacaaaataagcaagagcttgaatatgatgatcaaatattaaataaacaaggatataaagaatatgaatttgatcaaatgttgatcatcgaagaaaaaatacagcaattgacagatcaagaaaaagaaatatttcatctttattatattgaaggatataaaatcagggaaattgctaaaatgaaaaagcaaaaaatcaatcatatgaaagtaaaattatatcgaatcagaaagaagttaaggaggaaagagtaaatgaaacaaattgatactgataaaattaaggctatggttaatgatcgcattgcttataatctttatgaaagaaatagaactatgaaaaaaatgaaactaaaaaaagccgtatttagtattgctgtatgcgttttgatattaggtggaattggtacagttgatgcggcaactgatggcaaaattagtaataccgtcaaaaatacaattaaagtaatttttactgatgaaaataatcaggaaagagaaataacgggagaacagtatgttgatgaaaatggagacatttggatcaaatataaacatgaaactgatcaatcaagtcaggagatagatataaataaaagtgaattagaaaaagatggtcttgaaactgatgctgacataaagaattcagatggtgaaacaactacagaaatcacgattcaagataaatagagtaataatttaataatctcacattaatcattgttaatagaatatgtgagatttttattgtaaaaagatcaaacactgtaataacgaatattattttaaaatatataaatgctaaaaattaaatcctagaaaatgcttcaatatgagcctaaagtgatttttgacaaatataacgttctttataattaatgggaaaaacgattatttttatagtataattacagtagaatgagaaaggattttgtatacatgataaaaataatttataacaatggggatataatgataatattatctggacgtattaattttgatattaattttttatcaaatatagctaaattatttgatgttttgaaaccagtaaattataaatatcataatctccttttcaggtgtgataaatcaactcatattgaaaaattagcactagcctatatttataatgtttgctcatatataaagaaaactatgaaaataaaaatttttatgtctgaaaatttctattataaactaactggtattgtgaataatatgagtggggaaaaatataaagaacaagaatttaaacaagagattgctacggaagatattaaacattatattttatatggagaagatgaaatcaatgctgttgtaaatgatttgataaaatttataatggacactaatgtgatacttgataaagataatgtacaatcatttttaaaaacaacaattggtgaagtgttttccaatgcttgtattcataataatataaacgagtattattattttaaggatattatatttgaaaatgacaatttctatttaatagttaatgttgttgattatgggaataccattgcaaaaaatgtagagtcatattttcgtaaaaataaaatttctcgcgattgttgtattgaatgggctataggggcaggaaacacaacaagggaaggaagtggtggatatggattaccaacacttttggactatgtagaaaaagcagaaggagatttaataatattatctggaaatgaaattctccatatgaaaaatggacataaaaattttcaaaataagttattgggattttttcctggcacagctgtttgttttaagattaaattatatgatttggataattgctttatatatgatgaaaaaaacaagacactttctactaggagaataagtctaaatgatatataatatattaaaatgagggtgatagaaaatggaaatagaaatttataaatttgcacaaggggatactgctgtgtcttatgatgaaggaaaaaaatgttatactttaataaagcaatgtttgtctaataaagaaaaaatacttcttaattttgagggggttaattatgttataacagcctttttaaatccaattatcggtgatttgattatagaaaatggaaaagatgttatggaacaaattgagattgaaaatgcaaataatgatattctaaaaaaaataaaaatagttaaagatggagctcttttgaagagaagtgatttagattagtaaaaaagcttttttagatacatgtatatggatggaattatgtgtattatcaaatcctcaaaatcctcatgaaatttctcaaaatcgtaaagcaactaagttgttaagtgatttgatgacaaaaggagtagaaatagtttctttgaattatcagattgttgaattaatgcaagtgattttgaaaactaaaatgaaacaatgtaatagaaatttgagaaaaaataacatatctggagtagcaaaaaatataaaggagtttagaaataatcctaattgtcaaagttatcttcagcaagcattattagtttgtgaaagcacatatgaagatataaaaagaatgtcatcaactatagatgagtattcaattgatgtaaaacaaataattgcatttttggaaaaattagatgtaaatgattgtatatattatgaatattgtaaaaaaaatgaaattgatttatatatgtttgatagtgactttgcaaatttaaatcaaaaaattattaaagttatatagataaaaattaagttatactcattattttgaggtataacttttttgtatgatcaataataaagccaatattattattttattataaattattgttcattttgaaaatagctattacatagttttcggatagtttgaatcaataattacatcaaaaagtatataatgtgattaaaatattttgtgattggattttaaaaaatcaaaatgtacgaaatagtgaaattaatatacttaatcatattaaaattacaaaagttttatgtgaatatcaaagaaataaaaggtaatcaaaaatacagatcaaacattactatacgggaaaagatattaaaatttattactttacgcattaaattgaatactttttctttaagatgcgttataataggaacaaatgaggtgaaaatagtggaaatagcattaaaaacagattcaagaaaagtaaagcctggtgatacgtttattgccattgttaatgttgtaagagatggtcatgattatattgaacaggcaattaaaaacggtgctgttaaagtgattgttgaacatggaaattacagtgttgaaactgtagttgttgaaaatacacgagaatatttaaaagaatatctttataaaaattattatcctttgattaaagatatgaaattaattggaataacaggaactaatggtaagacaacgacatgtttgatgatctatcaaattttaaaaatgttaaagcaaaatgtagcttatatgggtacagttggtttttattatggtgatgttaaacgaaaaatggtaaatacaacaccagatgttgatgtattatatagtatgttattagaggctaaagaagcaggtgttgattattttgttatggaagttagctctcatgctttagataaagaaagaatttatggtttagagtttgatgaggtggcttttactaatttgactcaagatcacttagattatcataagacattagagaattatgctaatgctaaaaggaaattatttacaaaaacaagaaaaaataaaattgcgattattaatggcgatgatccccactgtcaacattttattttaccagaaaataataacattattattagtaaaaaagctggtgatttaataattgatgaaatgagattttctcatttaggaacaacttttaaattttcatttttagataaaaaatatgaagctgtattgaatatggttggtagatataatatctataattatttgattgcactgcttttagtgaataaattaggatttgaaattgaaaatattttatcattaaatgaggggttaaaagcgccatcgggacgaatggaactgattaaatatggaactaacagtatttttgtagactatgctcatactccagatgcggttaaaaatgtcttagtcagtgctcaggaatttaaaagtggtagaataattacaataataggctgtggtggaaatagagatgctttaaaacgcccgatcatgggtaagatagcagttgaaaacagtgattatgttatttttactagtgataatccccgaaaagaagaaccagaagcaattttaaatgatatcgttactgatttgtctgctgataattttgaagttatcgttgatcgtagaaaagcaatcatcaaaggtatggctatacttgaacataatgatatcttgatgatcttaggtaaagggcatgaagattatcaggaaactaaagatggtagacatcattttagtgatcaagaggaggtatcaaaatatattgttgaacatccgtctatttgaaataaatgattattatgaagtttatgatttatggaaaaacacagctggtttgggattaaggagcttggatgatagtttagaaggaatcaaaaagtttttaatacgtaatcctaatacaaatcatgttgctttagtagatgataaaatcgttggggtgattatggcgggaaatgatggaagaagaggttatatttatcatttaaccgttaaagaagatcatcagcgtaaagggattgcaagtaacttagttaataaatgtttagaatcattgaaagttgagggaataaacaaagtagctttagttacttttagcaataatgaagcaggtaatgctttttggcacaaattaggctttattcaacgagatgatttagtttatcgaaatttaagtttaaatgataaaaatatttaaaaagtaataaataattattttttattacaaaatattggatactacttgacaatctatcgatatttgttactatatagttgttgtgtagcataaaatataaacagaatgcgtaagtcccttacctgttcggacttacgcatttttattttgctatattttgctgcatacaagttacttacaatagttcgtgataggaagggagaaattaattatgatgaaaaaatttttatttgtttttgtagcgttaactcttgtatttgtttcaggtgtatctgtatctgctgcttctacagtgattagtgaagatcgagcaaaagaaatcgttataaatgatgctggagttagtgctgatgatgtagtttttactaaatttaaacttgataaaaaggcttatacatatgaaattaagtttacatgtgatagagataaatatgaatatgaagtttcagcaaaaaatggtactattttaaaacgcgaatgggatataaaagaaactgcggcaattactgaagaacaagcaaaagaacttgcagtaaatgatgctggagttaatattgatgaggtagttttcactaaagttaaattagatgaaaaaacaagtgtttatgaaataaaatttacttgtaataaagataaatatgaatatgaaatttcaattaaagatggtagtattttaagtaaggaatgggatataaaagaatctacttcacaaccaactagaccagatgaaagcgctaaacctgattattctgctgtacttgcacaagcagaagaagttgcattgagtactgctggtattgatcgggcagtaactaaatatgttaactcttatttaaattatgaaaagggtgtaccatgtaatattacagttgaatttggagtatatgttcgaggtgatggtacacaaaaatatcattatgtagttgattttgaaggaaatattctttaatttataaaataatatataataactgttttagggtaagatgattttcttaccctattttatttaaatttaaatattgcgataattttgctgttttattcttgattttttattttttaagctgataatatcttgagtttagaagtaaaaatgccataaaatcgggtaaaccccttgatatataaggagttcacccgatttgtttttttacttttgatgtagtgtaatttctcttttttctaatattttaataatttttttatttcatctctttttctgtattttttattgagatcaatatcaaattcttctgatatgtcttttataatgctgtcattatatataaactgatatatgttcctgtctatgtttatgcagttgtatttttttgcagtttctattattctgtctaccgaatatttataattcagtcttttttctaggagtcttatcatgacaagtgctgtaaaacaggttagaaaatgcccttctatatgttcttttgtccacacaaatgttggtcttgcttcgaaatttgttttactgactttgaaagtatcttctatttttgtcagacctctgtatatttttcttatttcgtagtcatccagttcaatttcacttgttacgatggaataatatccatcatatttttcttcttcttttatcttttcttcatctaaaaagagttctttttctgttttgatttcaccggttgttctatcgaattctatattactgatatatccagcagcaccgtatgatgttgcttttgtgtatccagctggatttttgatcatctctcttgcttttttgatcattctgtttctgtcgtttcgctgtttcatgagatatttgaatgaaaaataaaccatctgtttttgacatacattgacctttacttttcttttgccgtctcttgtaattttgatttccttggaatacactcttgatttatgtgtaaaggtgttattcggtggattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacagtaaaggcaatctttttattgttttcatcaataatatctgttttataccctttttcatcaagtacccactttttaaattccttgtctgctcctcttacagactgtccataaacatatccgtctctttttgaattttcatcattattgaagccggcaatataaaatatattatctgatgtattcagtcccctgtctgctacaacgatggtacgttctataccaaaatcagcttttgtttttttcagtataggtcttaatgatgttttttcggattcattgcctggaaaaatatcataggacatgggaattccactggaatccatcaaaagtcccaattcaataatagggtcgggtcttttgtttttttttggaccgcgttttctcatgcctttttcaatgatttcaccattttcatcaataatatcatcatcattgtattcaatctcgaaatagtagtttgtacagtcataatagctttttgagcagtctctttgatagaaatcttttgatttgtcccagaggagcttgaggatatcgtttttatagagataaaaatagtcaagacagtcataaacggaatctctggtaataccattatcaaaaggggcaaagaaaagatttctgttttcgaatgtcgatttctttgaagagggataaagtattcttgaaaaaacaagaagttcaagatttttattcagagaaaactggatattcagtcttttttgcttatttatgcagaaatcgttgaggccgagctgattgtagatatatttaaaaggaagatatccaacattcaggcagttataaccattatcaatataactgttaagatctatagaaagagaaaaagtagaatcagccttggcatcagctgtcatttttttagcgagattcttgaaatgctgaacaggatcctcataatttttttcgagttcatcgagaaaaccgatttttttgataacacgctgtttgacttttccatcttcgcgatagccttcaacaatagaaagaaaggaacgaccatttttaaatttagcgactttaagaaacataacgaccaacctccaagaacattataccacaaaatataacaatacacaacacaaaaagaacaaaatgttgacattaaaaaaagtcctgaatcccatgtaggataaggacttggcatagatgatagtataataactgcttcgaaactcgggtgttcgaggtgatggtacacaaaaatatcattatgtagttgattttgaaggaaatattctttaatttataaaataatatataataactgttttagggtaagatgattttcttaccctattttatttaaatttaaatattgcgataattttgctgttttattcttgattttttattttttaagctgataatatgtatgtgattttaagatgaggtaatgtagatgagaatacagcaaattgatatagaagaaattagttttattaaaaaaaattattctgaaagtttatatgaatcaatcaaacggatcggtttatctttccctatcaaagtagtgattgaaaatggaaaatattattgtcaagatggtcacaaacgaatttcggcaatttatgatatgatcgatgaagatgtatatcataaaagacgaaaaattaatatcgttgtaatgaataatggcaatagtcgttcaaatgactgctggcgcgttaaaaatatgcattagtaggaatgattagattatttctggatataatataaaaaaagatatttgcttttaaaaatactaggtgataaaatagtatatataaaagggagtagttagccattgaggtttacgagtcgtcagctcgataggtatatccggatcgtaattaaacaacgagacttttattgtatgcaaatacgataggagtctcgtttttgcataaaatattaaaaaggagagagaaaaatgttttataatcaagaattacaggaattagtacagaagttttcaactgatttaaaaaatggattaacagataaacaggctaaagataatcttgaaaagtatggcccaaatgaattgaaaaaagcccctaaacaatcattgatagtgagatttattttacaatttaaagatgttttaacaattatcttaattattgccgcaattgttagtattattgttgaaccatcagaatggatcgatagtgttattattattgtggtagttatcattaatgctattttaggattagttcaagaaaataatgctcagcgtgctcttgaagcattagaaaagatggctagtcctaaagcaaaagtgattcgtaacggaaatacaattacagttgaaactagtaaagttgttccaggtgatttgttagttttagaagccggtgataatatagctagtgatggtcgtttaattgaggcttttaatttaaaggttgatgaaagtgcgcttacgggtgaaagtgtaccagttgaaaaaaatagtgcgataattactaaagaagaagttcctttagcagagcggaataatatggttcatgcttcttgtaatgttacttatgggcgtggtgttgcattagttacaacaacaggtgaaaataatgaagttggtaaaattgccacaatgctgcaacagactaaaagtcaaaatacacctcttcaagatcagttggatcaaattggtaaaagtattggtattttgtgtattataatttgtattgtcgttttctttatggaagtattatcagggttaactgctctagaagctttcaaaacagcaattgcattggcggtagctgctattcctgagggattagcaacagtcgttacagtagttttggcattaagtgtacaaagaatggttaaaaagaacgctatcgtaaagagcttgccagcagtagaaacgttaggtagcacctcaattgtctgttctgataaaaccggtactttaactcaaaataaaatgacggttataaagacatatcgttataagcagcaaattgaaccacttgaaacatgcagtaaagaaacaaatgaattattgaattatttcactttaggtagtgatgggagtatcagtaatatagctggtaaagaagtcttaataggtgatcctacagaaacagctttagtgaaagctagtttagaaaaaggttttactaaagaagctttggcaaaagattatccaaggttcaacgaattagcatttgattcaaatcgtaagatgatgacagtttttgtgaaacatgaaggcaagattctttcaattactaaagggggtccggatgttgtatttagtcgttgtaaagatcttgatttagaagaagttgatcgagttaatgaaacgatgtctaacgatgcccttcgggtattagctttgggaattcgttattggcaaaaaatgccagataaaattaatagcgaactagttgaaaacgatttaacttttgtaggaatggtaggaatgatcgatccacctcgtgaagaagccaaaaaagctgttgctgaagccaaaaaagctggtgttagaacgattatgattactggtgaccacgttattacagccagtgccattgctcgaagtttaggaattttggaatcaaatcaaaaagcgatcatgggtagcgaattagaaaagatgagtgatgattatttacgtgagcacattgaggaatattcagtatatgcaagagtagctcctgaacataaagtaagaattgtaaaagcatggcagaatcaggggcaggttgttgcgatgacgggtgatggtgtaaatgactcaccagcgctaaaagctgctgatattggctgtgcgatgggaattacgggtactgatgttgcaaaaggagccgcaagtatgattttaacagatgataattttgcaacgatcattacttcaatcaaggaagggcgcggaatttttgataatattaaaaaagatgttcagtttttgttatcaagtaatattggtgaagtactaactatttttggtgcttccatcatttctttgcttacaccatttgattttggagtaccgttattaccaattcatttattatgggttaatttaattacagatagtttacctgcttttgcactagggatggaacctgtagaacctgatgtaatggagcgcaaaccgcgtgataaaaatgaaagtttcttttctaatggattaggttttacaattgcatggcaagggataatgattggaatattaacattgattgcttatgcaatcggtaatcaaatcgatcatttgacaggaatgacaatggcgtttattactttgtgtggctgtcaacttgttcattcgtttaatgttaaatcacatcattcgattttaaataaacgtttattcaataatgtttatctatggggatctttagcggcaggattattcctacaagttatcattataacaattcccgaattagcttatatttttaaacttcaaaggctccacctagttcaatggctaatttgtatcggattatgtttatcgacaatagttatttgtgaacttgttaaattatttcataaaagtaaatgaaattaatagattttgttatttggtatatgtaaataatataagtttagagaaaattcaaaaattatcaaattaataagattagattttgataaataagggcagtctaatatgatattttatcatattagaagcctttttatattactttagaattatataaatataatattaaaaattaaaaatatgttattattttgtgaagaatataaaaaaatataaaaatgtgacaattgtcacttaaaaaattggtataaaaaggtatataatttatacatacaattagagattacatttaatggcgctaagaaatgttggtttttgttgtaaagaaggggattttgtgaaaatgagattatggcgaataataattagacagagcatgatttggtttattgataattaataaaaaattgctttgccgacaaggtaaaatggaggaaaatatgaaaaagttattcaaaatattattagtttgtttgatggtatttggtatagttttaccttcttctgtcagtgcagaagaaacaaatccagaatatcgtttacaatatcatttttctaatgaaaaaggatggagtaatgatcctaatggaatggtttattataaaggacaatggcatttattttttcaatactatccagatggtgtaaatcatggtccaatgagttggggacatgctgtaagcaatgatttggtaaattggacagaatatgatattccagatgtttttaatgcaagtttatatccatcagaaaatggtacaagaaggcatttttctggaagtgttgtttgggataaaaacaacacatcaggctattttgatggtgttgaagatggtggtcttattgctgtatggactattgctggtcgaccaagtggaatgagcggtggaggaagccagagacaggcaattgcttatagtacagatggttttaactggactgagccagatttaaaaatagaaagaaaatatactaattctaatggcgaaacattagatttaactgatattcaaaaagagtattataaaaatgtcatattagctgaatataatgtattaagagcagatggggaaaacttagtatctgatgatccattaaataatacagcatttagagatccaaaagtattttggcatgaagaaagtaatcaatggatcatggcagtagctggaggaccattgagattatattcatcaaaagatttaaaaacatggaaagcagaagcaatgcaggatgatatcattacagaatgtccagaaatttattatctacctgttgaaggaacaaatgaacatagatatgtattaagcgaaggtggacgctggtatcaaattggggatttacaagaagtagatggaaaatggacatttgttgctgatactggtgctgatggaacagcagctcgttatgaaatgaattatgctcctgatgcatatgctgctcaaagttattataattgggatggtagaactgtaatggttcaatggatgagtaactggtcttatgctgataattcaaaagtaaatggtgttactttagaaggattaagaaaagtattgggtgaagaacataatggacaatttacattaaatgcagaacttactttagtaaatactccttatggattacgtatggcacaaacaccagttgaagaatataatgcatataaaaatgcacaatttaattttgaaaatgttactttagataatcaaacaaacgtattagaaggattaaagagtcaacagttccagatggatgttgaattcgaagttgaaaaaggtacaaaagaagttgaaattgaagtactaaaaaatgaaaattatgaaacaaaagttatttataatgtagaatctcaaacattgacagtagatcgttctaattctatgtcagctgaaaaggcacctgctgatcactcacaaaatggtacatggtttaaatttttatatccttattcagcacctgttccaatgaaagatggaaaagtatctttacatatttttgttgataattattcaattgaagtatatgcaaatgattatacaacagtattaacagaattagtattccctgaaaaagacgctttaaatatgagcattggagcaacaggaactcctgttaaagcaaatattaattttgcaacaatggacagttatagagaagctaatgttgatttaagaagtattagtgcaacattacaagatgcaaaaaattatttaaatttagaagatagctatacagtagaaagttttgcaacatttaaagatgcttatgataaagcttttgcagaagtatttaatagtgctgcaactgatgaatctgtaagtaaaaatgaaacagctttgattaatgctattaatggtttaacaaaaaaatcagatgattcaacaactatccctggtgaaaataatcagccaaatggaaatgaaacaacagatccaaataattcaaatgtttctctaaacaataatggtacagtagttgaaaagaataaccctgttaaaacaggcgatagtgaaaatatcttattatatggtagtatggtaattcttacattatcaatcgcattaataggattgaaaaaaagaatgataaaaaattaatatagatatgtaatatctaagatgaaaagaaaatagaaagtatagaatttataataggttcttactcgcttatgggtaaatgaacttattagacagcacaagaaattgtgctgtttttctttagtttgtatttcttgtttttgggcattttgatacaatatatgtatggatggtgatacatatgaaatataatgaaatcagtttgaatgaaaaaatctttggtaatgacttcattgtctatgactggaaagaatcagataataaaatcataatatatgtgaaagcgacttctcatgatgatgtatgtcctgtatgtggttctcctacaagttctttacataatacctatcatagaatgattcaggcttatcctgttagaaataaaacaacttttattaatgtaattgcttataaatatgactgtactaatgacaaatgcaatagaaaggttattatgcagaatcttccttttgtttctccctctcaaagaagaacatatgagcttaactgtcttatccttgcagtttctctctttttaagcaatgaaggtgccagtaaagtactgaaacttcttggggtcaatataagcaatgactctatcaaacgcctgactgataagatcattattgaagatgaccctgatgtcgagtctattggaatagatgatgtggcgatgagaaaaggaaagacttatgcaactgccatatatgatatggaagatcatcatcttattgcgcttttagatggaagagataaggaaacagttgttgaatggctaaaaaatcatcaaaaaataaagattgccacacgtgacagagcaagtgcatacgcttctgcaatcagtgaagttttacctgaatgtatccagattgcagacagatttcatcttcttcaaaatttaattgacagaataaaagatatttttaaaacggaaataccggaaacagtattcataaaagatggaaaggtactggaagaggaacctcaaaaggttccagcattaaaaatcgatccaaattcaaaggaacttgaaaaatatgactatgacaacagtatgccagttgataaagaaggaaatatgattgattttgatgcggtatgttatgataaaaacgataaacaacacagacagcaggctgaaagccgtaaaaaaaacagaaaatgatcattgacattcaaaaaagatgggaggaactcgaaaaaaagaaatacacaacaatagctaaagaattttcaatatcaaatattgtagctaaaaaatatgtaaatatgagtgaagaggatattcaattgttggacagtccaaagaaatacaaacaaagaaaaacagctacagatgactatatcaatatgatctataaaatgatcctggatggaataaagccagaaataatctttagctatgtcattatgaaaggatataaaggtacgtggaagtcattggataacagaattgtatacttattaaaaaataattttagtatttctctttcaatggggtggcatattaagtataaatatccagataatatcatcatcataaaaagaaatgaaatattaaaatacataacaactaaaaatgagaaaacaaagaaaaataaaacagttgaaaaaaacattcaaataatcaaggaaagatatccaattataactgaactagaaaaaatatatgattcgttttacagcacgatcaaggaggcagatactgatcagctagataagtttattgataattatagagaatcagtattaaaaggatttatagaaggtatagaaaaagatattgccccgatcaagaacgcaatatcttatccatatagttcgggatttgttgaaggaaacaacaacaaattcaaactcatcaaacgtattttatatggaagaagcaaaatagtcaatctttttaggaaatgttacataccatttttaatgaataataaagattttaagctaattgatattttagaacacaaaaacagcacaatttcttgtgctgtctaataagttcatttacccataagcgagtaagaaccttataataactatactttctatctttatttttataaaaaattaaagaaaaatatgtgttagttaaaggatagtattctagtaaataaaggggattatgattttatattcctctatgatcctactattatattgatagatttatacaagtatggtttatagaaaattaaatgtaaaattataaatagatcatttctgatgtgcctgctattgtaaataaagatttttatattacttatcagtgtagatttatcaagtatttgcacttttaatacagcaggacttgaaaagtatcttataaaaaatagaatattgttattgaaaagttagatgcagagtcaatagtttagagagtattatgtcttaaattcattggctctattttatttgtcagctaaaatagtaaaatgaggtagtggttcaaagatacaactctagattagtcaatatgatagtttgatttcaagtgcaaatcagatgttttatacaagatgatgacggtataatagttttaaattgttattaaaaaagttgcgtacgctactatattgtgctatactagcttcaataataagagaataatgtcgtaatcgattgctggatgcgataactctatatttatttcaattaaggcaggtgaaaatttatgaatgacaattttcctaatatagcgcgttacatttccattatagatcggctaatgaaaatgtattatgaccatgggttagctgattttgaaattggctggggtcagcagttttatgtggaatatctctatgatcatcctggcacaactgctcaggagatggtcgaatgcattcgggttgacaaagcaacactaactaaagttatcaagaaactgatggagaatggttatatcaaagttattcgaagtaaaaaggataagcgtataaaacatctttacctgacggataaagctattcccgctgttagacgtatcaaagaaatacaccgtagcttttttgatacactgtgcttcgaaatttcgaaggaggatattcataaaactgaacagacgatatcgaaaatgagtgagaatctaaatcagaaaatatggcacagaatggacaaaaaagatagttctaaagtgaaataaggaggtacaagattcaaatgaaaaaaaatgtagatatttcagcaacagataaaaacggcatatttattaccttgatcgtagcgacatttattacagcaatgtcaactactgtaacgggaaatatgattcctaactttaccaaatattttgatgtatccgctaatcttgctcaatggctgacaagcggagctacactagtctctggcattattattcctgttacagcttttctaattaaaaaagttcccaacaaaatatacttttttgttactatgagtgcctatacaataggttctttggcggcttttttggcacagtctttttatatccttcttgtaagtcgcttagtgcaggcagtaggttgtggaatgatgataccgtttggacaagtgatgctactaaatgtctttccttcagaaaaacatggaagggttatggctgccttttccatggcatcgatggtatccactgtcataggaccaacttatgcaggattaatgctggattcttttggttggcgaggggtctttgcgtctttgtttgcctttggcattatcatcataattattggaagtatttttatgaaaaatattactccaagatcagatgccagcctcaatatgggttatgttattatctcagcaattggttttgcatgcttattgattggtattggtaacataagcggtaaatcaatattgcagttaaagagtggtggaatcatggtaattggggtgattgctctcataattttttcttggctgcagcttacagcaaaaaaaccgatgttgaatcttcgcgtatttcaggattcttcctttacgattgcagttataatcagcatctgtctatatttgattgccatgggatctgcaatggttcttccaattttaaccaaatcgatatgtggctattctgattcaagttatggctatgcaacacttgttggttctattctatcagtatttacaactctatatgtgggcaatatatatgataaaatagggatcaaaccaatgtttattaccggagtgattatgtttgcggtatatacgtttatgggaatatccttcacagaacatacaggaatcatatatattgcagttgcttttgcatttcaaaccgtggcaatgtcagtattaaactctcctgctacgacaatggcattgagcaagctctctggaaatgctcggatagatggaagtgcggtttttaatacgatacgtcagatttcaagttcgctggcatcaacactttctgtacagatttttacactggcaggcagtgatattaatgcgatccatattgtatatatctattatggagtggtaacagttattattgtgatagcttttctcttgtttaaaaagtctgaatcacatttgaaagtatgataaaattagttttgtttttataacgcaatataaagaaataatccctcaacactgattataggctgttgagggattttgcttaattaaaatctgttatttttagaaagttatgttttactgatttaatataggtgactagtaaactttgatgatgacctgtcatcgttttatagattggatatttaaagaagtagactattaatttaaaagatagatgaagtagtttaagtaccctgcaaagcttacccataaaagataaggtaccatcaaatatccagctggttttgatatatgataaaataaaatggtagtttcaagaatcagcagccacaatagtataagccaaataaacgcaaacaagtatagttttagattgaaaaaaataattgaccataaaaaattaaaagcaagttgaatactgtatacggttaaagcagtatgattttccttacaggatgtaagaactagatatgacgcaattcccataaggatatatagaatcgtccaaactattggaaacagccaggccggtggagctagaattggtttgttgattgatccaaaagtttccatactgttttgtgttagcagtgctgacaagctaccaacagcaagtggtataacaagacagataactagttttttccattgatttttcaaaaaatcacctcctactacagttatgatttaatttgcactattattctaattacaattattatttaataaaatttttataatagaaactaaaagagttatttgatttaaatttagtgtataaaatattaaattatttcattgtatatgaaagaattctttttcttgatgctttatagtgttaagattatagtaggagaaaagattatgaaaataaatattattaaaaagaaagctagtagtttaaaagatttaggaaaagaaacaattgaaatcccaagtgtttcaacattaaaagaattattgttagtgatattctataatgaatacaatcatctttataataatcagataaaaactttaactgaaaaagatatcaaatatttagctaagttaggaaaaatatctttttcaaatctatacaatactgataaaaaagatttagatgatttaatcgaaatcatgtttcaagattttactgatggactttataaagtctttatcaatggacaggaatatgaaaatcttaatgagcatattcaaattaaagataacgatgagattgtttttattcgctttgtcatgttagcagggaggttatggtagtggagagaaaagatataattgcgcaattaagagaatataatcagacactatcggtattttgcactcatttagaaaaacaatttatcaaacaagtccagcaggattatttttatagtttttattttaaagatgttcgtattttaaatgatgttgaaagttttttgaaagaacaaaaatattttaaaggattactccctaaacattatgaaaaattatgtcattatttaagatgtatgcacgaatggacatgtaatgatcaactcattaggatggatgttagaagtaagaatttttctgattatcaaaataagataattagggcaattggttcattttatgtgttttatggtacggatatgacaatgaaagagctgatttatggtcgatatcgtcaatttgataattggatgaatttttcgagtgttattgctgaacgcttgttaagtgatgatcaggatgtcattcaatactgtaaagatgttttaacaagcgataataatacagctgttttaacaagaaacgtgattattgctattgaacaaagtcatcatcaagaactacaggatttattaactcagctttttttagcggccagattacaagagggattaaggcaaagtgttatagaaacagttgatgaaaataatcttgattattttttaaagatgatcgatgtaattgctcaaaatgatctattaagatattcatcagttcaaagaggtgttttgacctggatagggataggttatgaaattgtaaaagaaaaagatgttcgttatattttctggcatcttcaagattattttcataatgaaaataatcgatctcaggcattacaaagtgaaaatcctttagatatttatttggctttatattgtaaaggtgtctatgatgttaatcaggcaatagatgaagcgctaattttattaaagagttctaagcgtcatattgttgcttgtgctttgatttatttaaaattgacgaattgtccttatttgcatgcgttgctgccttatttaaaagattatcatcatgatcaatggatcatggctctttttattagtgaatgttgccgttatgattatcaaaaagcagttttaacaaatgatgaattagcacttatttttaatgagatggaaacttttgctaaaacgatgaaaagtcaagaaacttatttgtcacgaggatttgaatggttttcaataacgttatataaatcaagtatttgttatcatctttatgatataattgcagcaaatccgcaaatagaatttattgaaagatatttaccgtatgttgctagtaatcttcatgataaaagattaaaacaatttatggaagaaagatttccattattagatgaaaacaagaaaaagacttttatgttaaaagaaatcatttctaataatagtgagctagcaaattatattgaaaaagaatatataaaattaaatctctctagtcaagatattattgatcttgaaaaccgtttaaaaacaaaaaaagctcaggcacgagcacatatcgttcatattcttgcaaaacagaatcaagagcagattcagcaaagttatcaacgcttatctaaatcagcaaataaaatgattcaagaagcagcgcttgagttacagcaaaaggtgccacactattttcaggatgttaaaatcagtgcagtgaaaattcagggaaaagatgaaggatttgggttatatcgtccttatcagtcttatttattgccttatcattcaaaaataaaaacaatcaaaaaaggtttaattattaaaaaagaaaaaattgatttttcaacactattgccatggaataaacaacaagttcttgaatatttaaaaaaatgggatcaaagaattattttacatcaaaatgatgaatattataatggatatgaatatcgacaattaaagtcagagtatttttatcctcttaattatcaagaacactcattaaaggctttacctttaaatgagttgtggaatgaatattttcaacaagatcaattagatagtgatattgtttttgaactccgtttattactagaaggaattgaatttgataagattcttaatttagaaacaccattatttactctttatcaaaaggatatcgaatcattacaatactatcagcatattacaaaattaatttcttactatttttatgaatatgaaaatacaagtaattatcgtgataaagcttttatgcttttagaagttatcaataagcattgtaaatattatcaatacaaaagaagaatttataataaccaatatgaaattgtgagcctaagtaacatatttttctttttaattgctcaattgcatttagaaaacgctaatgatcaacagttccaagaatattttccgatgatgatgcactgttatgaaaattttaatctaaagtgtcaacgggatacacaacataaatttactatttcaccaatgattttagctcgagctgctttgttaggaattattagccaagaagctttttatgaatgtattcttgatagtcataataatagtagtagatatacaaatgatcagcatcagctttttgctgcttatcgagatgcttattttgaaggaacaggagtttggaaaaaaccacagttaaatttagaatgctatcatcataataggttgaataatgatattgaagtttttgcttatttaagaaaagaacttgatttgatagctgatcatttaatttcgatggaaaaaacaagattaaacgaaaaaacagctgttacgtcttatgttgaaaatctatatgttgttaacggggttaaatatcttattgatgccctgcatgttttagaacatgagacattaaaaaggcaacgctatggtgatgatcgaaacgttgtttttactgatttgatccgtcattgttaccctttatcaagtgatgatccccaaactttaaaaaacgaaaattttaaagaagagagacttgttgaagtggcaatgttagctccacaatggatcgattttattaatcgagttttaaattgggaaggttttaaagaagcctgttattattttattgctcatatgaaacaatatgattatcaacaaaagaaagcgcagattgctcattacacgcaaatagatcctcaagatttaaatgatggggcatttgatatggaatggtgccaaaatgtctatcagcttttgggcgaaaaaagatttcaaatgttgtatcgggcggcaaaatatttatgtgaaaattcttttcatagtcgagctcgtaaatatgcagatgcttgtttaaagaaaatagatttagagacattatatctacaaatgcgccaaaaacgaaataaagatgctttaaatgcttactgtatttatccattaaaggatgatcaagatctacttgaacgttatttagcgattcagcagtttttaaaagaatccaaacaatttggggcgcaaagacaagctagtgaaaaaagagcttgtgaaattgctttgatgaatttggctaagaattcacgctttgaaacagctacaagattatcttggatgatggaaactgaaatagttaaaaaatatgaatatgtcttacaaccacaccaggttgatgaaattcaattgtggatcgaaatagatgatcagggacataatgaaataaaagttttaaaaaataaacgaaaacagaaatctattccagctaaattaaaaaataatagttatgtactagaaattaaagatattcataaaaaatggaacgaacaatatcagcgttcgagaaaaatgttagaacaggctatggaagatcgaactgttttcatgattgatgaaattcatacgatcatgaataatccaatcgtagcaccaatgctttctaaacttgttttgatttctgatgaaaatttaggtttttatgatcaaggatatttaaaaggaatcgctcatcgtgaaaaattaggtaactatgtgcgcatcattcatccttatgatctatataaacgtcagtgctggcatgaatatcaaacgtatatttataaacagcaaatcattcagccttttaaacaggtttttagagaactttatctcaaattggatgatgaaaaagatcaatcatcatctaaacgttatacaggatatcaaattcagcctaaaaaagcagcggctgcattaaaatcaagaaagtggaatgtaagctatgaaaatggtttagaaaaaatatattatcaagatcagctgattgtaaatctttttgctcaagctgactggttttcacctagtgatattgaagcaccatgtatcgattatattcaattttatgacaagaaaaataatcagccaatgaagatttgtgatatcgatgatattgttttttcggaaacgatgcgagatgttgatttagctgtaagtactgcctatgttggtggtgttgatccaatcacatcattttctacaatggaattgcgaaaaacaattgttgagtatacatctcaattaatgaaattaaataatgttgaaattaaagatcattttgcatgcattcaaggaagattaaataattatagtgttcatttagggagtggaatagttcatcaagatggtggagcagtaattagaattatttctgtgtggagtggaaaacgtggcaaagtttatttaccatttttagatgaagatcctaaaacggcgcaaatcatttctgaagttgttttatttgctcaagatgataagatcaaggatccttcaattttacaacagattcaaacaagaaaagagaattcctagtaattttaatgtcatcaatttaagattgtagaaacagatagaaatctaattaaagataactatctgtttttatttaagaaaaaagaaatatgagtgtatgtagttttactttcttatggcaaaacagatatgttagagagcacaagaaattgtgctgtttttttggtttctttaacctcaccatcaaatgcttttatcaagagaaacagtagtagatggagattttctacgattaccatggataaaaccagccttaccatattgatagtatttttgaatcagtctattgacagttctagtttttagtagcagctcttttttgtcattagtttcaacaagctttttaattcattcttaaagcaactttttctccaatttaaaaatattaggtttatagtatacattgattattattataattgaattttataaattaacttttttatctttataaatttacaaatttaatatttatatagtataataaaataaatggaagggattattaaataaaattatcttgaggattaagtgtgaaaataaaatttgttattaatcgaagaaaataaagaaagtgagggtattacttatgataaaaataaatctcgtagtaatattctaaatttgtttagattaatagtaaattgaagctttgatcatatgtttgtgtccgaccgacgaaggcggacggaaatggaggaatttatgaagaaaaaaacaactatcattttcactatttatttagtatttatctttctttacccattattgaaaggatcaattgctcatgtcaacggctatccatcttattttgaaaaattaattaggtgtataaatataattcctttctattttgattatactgtaatgccagcaattattttaaaaaatattgtttttaagctatgtctatttattcctgttggttatatgctctttgcaccagaacaaagacaaattaaagctgcgaaaataatattattgattggattatcaaaagaattatttcacttattaattttatatggttattttgacataacagatataatatactatttaattggaggattaataggatatcatatccataaaataatatttggttttctttttactaatttatcgaacaatagagcataaatgaaactaaataaggagaaaaaagtctatcaactatttaagtttacgcaactcttagatatggatctagattatgactgacacaatccgatacttgatattcttgtagacgatcaattagactgacaaacgagaagttacatattcacttctataaaatggacatttgagttgttccagtatttcatataaaccctatctttttgttcgtcaaagtttaattggtacatacgaaaagtgactaatatatctttaggttgccattgttcctcatacgaatattgatacttcattccgatatttttcatcacgttcccgcttcgagggttgttgcgatcatgggttgctgtgatataaggaatcccatcttttttcacttgtgcaaccactgctttcccagcttctgttataataccctgatgccagaattcttttcgtagtccatagccaaaatcatggtgttcttccatatctacatttatataaccaataggaatgttatcttttttcaagcaaacagcataggcatatgcctgtggctgtgcatattttgacgcatatctctctttaaaaaatagtcgagtttcttcaaggctttctaatggaaatcatggcagaaatttattgacttctttgtcgctgtaaattctatacattgcttctatatcattttctataaattttcttaatatcagtcgttccgtttcaagtgttggtgtattcattttctgctccatcaattctgagttgttggtgtatttgaatgtaattatacattagcactacaggtagcacaagcgtaagtgctgaaaaagtcaattctgtaataacgtatgcgttttctctttatctgatttcatctataattgaataaagcaaaaaaggcgatgatttccctcataattaattgccttttttctttattgatattcatacttgtatgaatatagactttagtcaggatatgtttaatttatattaaaaataaagtttagaatattgtaagctatttgacgcttacttttcaccaaagattttttcattcaaagtgatttcattatacttaacatggatcgttattcataaaaatattatccataaatataaattcaaaggaaaacagcacaatatcttgtgctgcttaacatatctgttttacttataagcaagtaagaacttatctttttgctgctgatctttttagtctatgatttgattcattagttctactgcttccattgcatctttagaataatagtcagcattgatttctttagcaaaatcagctgttaaaaccgccccaccaacaaaaataggacacatatcatcaatttcttttaacatggcaattgttttttccatcgaaataacggttgttgtcatcaaggcacttagaccaattgctttaggatgatgcttataaaaggcttcaacaacagtttctggaggaacatctttacctagatcgattgctttatagccatagctttcaagaacaactttaacgatatttttaccaatatcatgaatatcaccatggacagttgccataataattggacctttggtagctgttgtttctttaaaagtctctttaatagtactaaaagctatttttgcagtttctgcagattgaatcagttgcggtaagaaaataatatttttttcatattgtttaccaacagtatctaaagctgggatcaatatattattgatgatttctaagcctggtgttgtttcaagtaattttttagtagtatttgctgcttcatcttttaaaccatgtaggacaatgtcatttaaactaaagtttgcggtttctttttttactacagtttcttgatttgactgatgttcaatataaacagaagcatcatggtcataattatataatacattaaaagcatcgatcgtcgccataagctgggcatctagaggattgatgattggtagatcaaggccggcagataatgccatagctaagaaagttttatttaataagggacgatttggtaaaccaaaagagacattactaactcctaggacagtatgtactcctaattgtttaaccatcgaaacagctttgatagtttccatgacttctttttgttgggcagaagctgttagaactaaacagtcaataacgatattatctcttgaaataccataactttcagctttttttacgattttcttggcgatttcaaagcggtctttagcaagtggcggaatcccgttttcatcaagtgttaaaccaattacgacaccaccgtattttttaacaatgggaaaaacagcatccatcgtttcatcttttccattaacagaattaattaatggtttaccgttataataacgacaagcttgttcgattgcttcaaaattactgctatcgatctgtaacggtaaagaaataacttcttgtaataatttaattacacgtttcatcgtctttacttcatcaattcctggtaaaccaacattgacatcaaggacgtgggctccagcttgttcttgtttgattgcttcaacgatcaattcgtcataacgctcttcttttaatgctaatttcaattttttctttcccgtcggattcaatctttcaccacatactacaacatgatgatcaaattcaactgttttagttccactcgatactcttgtagcgttgataggagttaattttgtttttttattaggaagattttttttcaaagccgcaataaatgctggtgtcgttccacaacagccgccaataatactaaccccgttgataacatgttttatactttcggttacaaaagtttcttcatccatattgtaacaagttttgccctctactaaacatggcaatccagcattgggctgtaacattacagggacagtagcgatttttaaaatatcattaatgatcggtgttaattcaattggtcctaaagaacaatttactcctaaaacatcaacattcaagccttctaaaacatttaccatggtaataggatcgcatcctgataaagttcttaaattactttcatatgtcatagtaacaaagacgggtagattactattttccttaacagccaaaactcctgctttgacttcataaatatcagtcattgtttctaataagatcgcatcaactctatcttttgccaataaaacctgctttttaatgatttcgtaagcttcatcaaaagttaaggttcccatcggttctaataattgaccgatcggtccaatatctaaaacgatataactatcattttcacgattagctttttgtcgagcaatgattgcattatcgatagctgctttgatcatttcatcataatgataaggagcatctttcatttttaagggattagcgccaaaagtattagtagtaataaagtcagctccagcatttaaataattaagatgaatctgttgaattaatttaggatcggtaatatttaaacactcaggaatatctccggcttttaatccggcttcctgcaattgtgttcccattgcgccatcaaatactagtatttcttcttttaatcttttttgtagcatctttgtcccttctttctatatatacaattttctaagtttatacatgaaaaacaatgtttagttaatttttcatcaccaataccaattaaaccaatcatagatttttgtggtaataataaattattttcttgaacagttaaaccaatatgcttattacaatttaaagcgtttgctaatttatgattgagttcaagagggacattaccatagccagggcaaaaacgaaaagtacgcttgccaaaattttgcttttcttcaaattcatcacatttaatttcaatataactactagctaaagcatccatgacagtcattttagtcatgtcgatcatggcatagtaacgtaataatttatccaattcaattcctaaagtgcaggcaatgaccacgactttatcacaactatcaaataaatcgattaaatcaggatattcgagagagagatttaattctttaattaataaaggatggtgttctaatgaaaagatttgatacatgaattttggctttaacttttcaagttctaataaacattcatctaaaagtctatttgtttgttcatcggcttgatcatctaagtagcctaaatattttaacgcattttttttaatcattaataaattcagcgaaaatattattagttctaagtaatatttctttagctatttcgggtttattcatcgtataaagatgaataccatcaacaccattagtaattaaatcaattatttgataagtcgcataattaaacctacttctttcattgcctgaggattgtttctaaagcgctcaatcattgctgataagttatatggaatattgcagccacttaatttagcgatatttaatagtgatttagaattagtagctggcattattccggcgatgatcggtacattgatgcctctagctcgagcttctctaactaagcgataataataattattgtcaaagaagatctgtgtaattagatattgagcccccgcatcgacttttttctttaatgcttccagatcactttctaaagaatcggcatcttgatgaacctcaggataacaagctccgcttagacaaaaagtatcaggataatttttactaataaattcatttaattcactagcgtgtttatagtaataaggagcagtgttaggatcgtaatttttaggataatcaccgcgtaaagccagaatgttttcaatattatttgcttttaaagagtcaatagtttgaatcagttgctctggcgttgcatcgatacagcttaagtgagcaacagcttcaatatgataatctttttttatctttgaagctatttcaacagtatttcttgttgttgaaccaccagctccatatgtaactgagataaaatcaggatttaatttagaaagctcatcaatagtgtgatagatcgagctaatgtcaccatcatgattttttggtggaaatatttcaaatgacaacgttggtcttttaagtaataaatcaataattttcatgtgtttttcctccatcgataaattacgttaattataaaaaaaacaggagttttagtcaactaaaactccttataaaagctgtcaatgattccttcgataatattagttaattgattagctaaagcagataaaaccataatagttatcaaacgctcatttttgtcattgatatcaagctgataagattcaatgatatttttaactaagggttccagctgctgagtttgtttggatttgatattgatgaaacgatcatagatatcttctaaactttcatctgtttcataaataggtgttaagatttcttttatctcttgaatggtaatggtattttttagattatagatcagtaacatgccaatgatttgttctttagtatactttttacctttaacaggtttgataactcctgctttagaataattattgatcatagttttagtaagaattttatcatcttcataacgtttattgtcttttaggttattttcaaacaatgtcatgatttgatccatataaagatccaatgatggaatatcttgactttttaaatcagttttattagctgtcttattaacgatttcagttaatttatccatggtctcacctcaaaaatattttaacttatttatatctttattgcaatatatagttgacatattctttattagtgttaatataaatatataatatagttatcaatactacataaggaggtcttgatatgagaaaacttgataaagctatggatccaattagttgtaaaacacatttcattggtgctcttttatcagcgctgatgctggttttaatgatggtaattgcaataatcgaaagatccgataaattaacgataattggaataacagtatttagtttatcgtcaattgcattgtatagtgctagtagcatatatcattattataatgcagctataaataataaagtaaaactgtttttaagaaaattggatcattcaatgatctatattttgattgcgggaacatatacgcctatttgcttaacgtatttagattatcctcataatttttattttttagctgtgatttggtcaattgctttactggggataatgattaaattattttggatgaaagcgccacgctttatttcaacggttttttatcttttgatgggctgggctttagtttttgactttccggcttttaaaaatgttcctgggggctgctttgttttaattgctttaggtggtattagttatactttaggagctattatttatattgtaaaaaaacctaattggtttaagcagtttgggtttcatgaattatttcatatttttgtaatggttggttcagcgtttcattttttggcagttattatttatattttataaagggccttggctctttattttattgtggttaagtaaagattattgtataatgtcggtgggtgataaaaatgaatttaacaaaaagaaataaattattatatttaataacactaatagtaatcactggtggtgaccagtttactaaacatctggtatcttcatcgatgcaattagggcaatcgcaagagataatcaacaactttttttattttacatatgcgcataatactggtgttgcctgggggatgctggcaggacatttatggctctttattattgtagcgttagtatcagctgttttaatgatcgtcttttttatgaaaacacgtcgcaatgaagtgttgacgcgctttgggttggtgcttacatttgcgggaatggcgggaaatttgattgatcgtgtaatgtatggctatgttcgtgattttatcgatgtagttatatttaattataattttcctatttttaatgttgctgatatggcagttgtgattggcgtgatattaataattattgagattgtttttgaggagtatatacatggaaaaatataatttagttattgaagatgaaaataattgtcggttagataaagtaattgctttaaagatgaaagatctatcaagaacgcaaattcaggaaatgattagtaatggatctgttcttgtaaatggtaaagtagctaaagctggttataaaactaagttaaatgatcaaattgaaattatgatggaagataatattgatttagatatcgaacctgaagatattccattaaagatagtttatgaggataaagacgttattgttgtagataagccaacaggaatgatcgttcatccttcaccgggaattaccaaaggaactttagttaacgctttattatttcattgtcaagatctttcaggaatcaatggagtcaatcggccgggaatcgtacatcgaattgataaggaaacaagcgggttattgatgattgctaaaaatgacgcagcccatcgttctttatcaattcaattaaaaaatcatactgtaacaagaagatatgtagcgcttgttcatggtttgatccctcatgtaaaaggtaagatcgatgctccgatcgggcgtaatcctaaagatcgtcaaagtatgtgtgttactagaaataatagtaaagaggcgataactaactttaccgttttaaaacgttataaaagtatgagtttgattgaatgtcggcttgaaacagggcggacacatcaaattagagttcacatgagttatattggttatccggtatatggtgatcctaaatatggacgtcgtaaagatgattttagtcatggacagtttttacacgctaaaaaattaggttttattcatccggtgacgcaaaaatatctagaatttgaaagtgaattaccagattattttaaagctaaattaaatgaattagaggaggaaatgataaatgagtaagataattaactggactcaatattttatgggagtagctaaactatcagcttatcgttctaaagatcctaatactcaagtaggggcatgtattgttaattctgataataagatcgtaggagttggctataatggattgccttggggatgtgaggataatgaatttccctgggaagttagagaaggagaattgtatgatacaaaatatccttatgtagttcatgcagagttaaatgcaattttaaatagtactggaaatttaaaaggatgtcgaatctatgtttcgttatttccatgtcatgaatgtgttaaagcaatcattcaaagtggtattggtgaaattatttatgaggatgataaatataacgggactgacagtgatcgtgctgctaaaagaatgttggatgttgcaggagttaagtatacgaaagtgcctccttttacaattgaagtcaaatagctgttaagttaaaaaggtttgatgatcgaagggctgtaatgaaatagtttttagctattcattacagctctttaaccttaattatatatacttttctttaatggttgcgttattttaatgaaaagtttgaatgattgtgggaattgcttcaaaattttgatgggtgatatttcctctgtagatttttctttggttttacagggattcttctattgttttttaggcatgattacaatattatcgattgaaaaatgttctagtttaatagaagctggttttgttgaattataagataaacaaataaagtatatttaaaaataaaaaaagcataataaaaaaggataacaatgttaccctaaattaaatctttaattcgcttgtaattagtcatgttggtttttgtaactttgtttaacattttaggtccgtatttctttgcaatttcaattgcaattgagtcgatagtgctactgttaccgtgaggtaatttcatttttaaactccgtgacatattagtgaaatattgtaaataagcatatttcgataatatcattgaacaaactatggctaaatacttttcttctcctttttgaacaaaggtcaaatctttcacaacaattacttcattttttaaataattataatacgtttttggggaaacaaactgattgactagtttgtctttgaccggcatacctactttttgcataacattagttacagcttgattatataattttgctttgatattagctaaattattaccagcttttaccatagcattataatgcgaattatctaaaatcaacaaactataaattagtcgatcttttatttccctagcgatacgaacaagttcatgattatccatatcttttggatcccgcactccaaggctgactaaccaatcaaaatcacgttcatctatgtaacaggcaacaacacataatggtccgaaaaaatcactagaaccagtttcatcacaaccaatatgattaagatttacataggtattagatatattactgctgttagctgtactagagtcgctaaaagctacaagtttatcgtaagcatgcatattaataacattcattctttttgaactattatttctcactacattcatgttcattacttgtcctcctagtcctactatttcagtataacatattttcaaactttttgacagtataaatttgttttgctacaatgtatattaaaagaaattgaggtgtttccatgagttttgttgtaaattcaatttttattgacataataattgtatttgttttggtattaatgttgatttttggatatattaagggatttgtttatcgcgcttatgatcttttagcgacaattatttccttattgatagctttatatgcatcttcaccactgtcaagtatttatacagtatataaagttgagggattaggtgagatgatcggaaaaacagtaaatcgatttattatttttattatcttatttattgttttaaaaatgatattattcttgttgggaaaagcggttaaaccacttttgaaaaatattatttatacttttagtatttttgagcagttagatcgattattgggaatcgttgttagtttgattggcggaattattaatatttatttagctttgatctttgttgtcatgccgattattccaggaggtaaagaaagtattgatgatactatcgttgctaaaaaaattttagagttggtaccagtagttactgacgaaattgaatcgttagatgttgttggtcaggtaattagtgatgggataaactatgatagctttgatgctagtaatatttacatggtttcactttcattaaataatgcatatgataatggcttgatcgatcaggcaaaactagaaaatactttattaaaatattatgatgatatagatgaaatacaagaacctgttaatcttgatcaacagcagtatgatgaagtatcaagattgttatcaaaggtggatcgtagtaaaatagatgtagataaaatattaagtaaaataatagtgagtgagtaggatgaaaaatatatatgatacattagaatttaatcaaattaaagataaagttaaagcttttggagttagtcttttagctaaagataaaattgattctttagcgccttatcaagatttagaagatttaaaattagaccaaaaatatttagatcaggcgatgcgtttgatttataaatatggtcgtttaccaattggccattataatgatgttgaaccattattattaaaagctaataaagatgggactttatttggggaagattttgttcaaatcgtttatttattaaataatgtaaaagaaataactaattatttatcagaaaaagaacttgaagaaaatgaattgatccaattatgtaatcagctcattttaccaaaacagttattaaaagaaatcaatcgctgtattgacagcagtggtaatgttttagatagtgccagtaaagaacttaaaagaattagacgccagattctatcgatcgaagctaatattagaactaagatcgaacaagtaaagacagctaataaagactatttgtcgcaagaagctatttcaagtcgtaataatcatttagtattgccagtcaaagccggaaataaaaataatgttaaaggaatcgtacatgctatgtcagcgacggggcaaaccatgtttattgaaccagaagttattgtttcgatgaataaccagttagttcacgctcgtgatgatgaactaagggaaatcaaccgaatcttgatggaattatcaaaaatgatcaaagataattatgatcttttacatgaagatcaagaattattagttgaaattgatgtcatttttgctaaagctggttatggggttcaaattgatggaatcgttcctgatgtaagtgaagattatcatcactttaacttgattaaagcgcgccatcctttgatcgataaagataaagtagttgccaacagcattgttttaaatgatcctaaacgaatgttattgatcagtggatcaaatacgggtgggaaaacagttgttttaaaaaccgctggtttacttagtttaatggctttatgtgggatggcactgccttgtaatcaggctgttgtgccaatgtttgatcagatctgtgtagatttgggtgatgaacagtcaattgaacagtctttatcaactttttctagtcatatgaaacgtttagtggaaattactaatgaagtaagtgaacggtctttagtattattagacgaaattggttctggaactgatcctaaagaagggcagagtattgctgaagctattttacgctatttgcaccaggtaaatcctttgatcgttgcttcaactcattattcagctttaaaggaatttgctaaaaatgaagaatatattttagtagcagcagttgaatttgatcaggaaaatatggcgccaacatatcgtttgatcgaaggtagtgttggtaattcttatgcgattgaaatttcttcacgtctaggtttgaaacaagaaatcgttgaattagcttatcagatcaaagaaagcagtttaactgatagtgataaactgcttgaaaagctgcaaaatgaattgactcaagttcagcttgaaagagatcgtttagaaattttagcgcaagaagctgaaaataaattaaataaatataatcgtttgattaataattttgaaaaacaaaaagatgatttaatggaaaaagctaaaaaagaagctaatcaattattagaggattcaaagcaggaaatcgatttagttgttgaggatctaaaaaaacatgccgttttaaaacaacatgtagtaatcgatgctaaaagaaatctagatttattaaaacatgaagaaaagaaactgatcaatgaagaaaaacgtgaatatcaagtaggtgatgtcgttaaagtattgtcagctaatcgccagggggaaattctttcgatcaataaaaaaggtatcttgacgatcaatatgagtggcttgaaactaaatgctaaacctgaagaagttagttttatttctaaaaaagttaagcctaaaaaagttagatctaatcttaaatcattacgtaaatcaactaatcagagctttgaattaaatattattggtaaacgttatgaagaggcgatgcttttagttgataagtttttagatgatgctctagtcaataactattcgatggtaaggatcattcatggtatgggtactggtgttttgagaaatggtgttagaaagatgttagagaagaataaaaatgttgttagttatcgtgatgggggacctaatgaaggaggactaggggcaaccttagtttattttgagtaatggatcgtaaagtaatcaaagataaactttctttattgccgttacagcccggctgttatttaatgaaaaataaagaaggcacggttatttatgtaggaaaagcgaaaaagttaaagaatcgtgtttcttcatattttgttggtgcccataattataaaacgacaaaattagtccaggaaatcgttgattttgattatattgtcactgactcggaaaaagaagcattattattagaaatcaatctaattaaagattatgcacctaaatacaatatttcttttatggataataaatattatccctatattcagttaacaaaagaaaaacatccccgcttaaaaatcgtcagaaatgcccaagataaaaaacataaacattttggaccatttcctgatggaacagcagctagagaaacatttaaacttttaaatcggctatacccccttagaaaatgtaaccatattcctaaaaaaccatgtttatactattctttaaatcaatgtttagcaccgtgtattcaagaagtagatgaaaataactataaacaaataacttctagtattactaagtttatccaaggtgatactaaacaaataatcaaagaattacaggaaaaaatgtttaatgccagtgaagtgcaaaattatgaattagcgaaagaatgtcgagatttgatcaatcatattcagcacgttacaagtaagcagcatgtccagtttaatgatttagttgatcgtgatattgttggatattatcatgataaaggttatttatgtttgcagctgttttttatgcgaaatggtaaacttttagcaagggatctaaatctcgttcctttacaagatgattttcaagaacagatcatttcctttttagttcaattctatcaggaaaataccgaacctaaggaattattagtaccgatggaacttgatacaagtttattagaagaaatcattaattgtaaaattattaaaccgcaaagaggcaataaagctaatcttgttaatatggctaatgaaaatgccaaggaacaattagaaaagaaatttttattgatccaaaaaaatgaagcagcaactattggcgcaattaaacagttgggggaattattaggaatcgctttgccaagaagaatcgaattatttgataattcgaatattcaaggtgcttatgccgtggctgggatggtctgtttcaaagatggggtaccatctaaaaaagattaccggaagtttaaaatcaaaacggttgaaggacctgatgattatgccagcatgaaagaagttatttatcgccgttattttagggttttaatggaaggtttggaaagaccggatttaattatcgttgatggtggtaaaggacagataaaagttgctaaagaagttattgatggtttgaatatgaatattatggtttgtggattggctaaagatgagcgccattctacgtcggtattgttagatagtaatggagaagttgttgaaatcaataaaaaaagtgaattatttttcttacttactagaatgcaggatgaggttcaccgttatgcaatcagctttcataaaaatgtgcgttcaaaatcattgtttcaatcgattttagataatgttgagggaatcggacctaaacgtaaaaagttattattgaaagaatttggtagtgttaagcagttaaaagaagctacattggaacaactggagaaggttttacctaaagaagtagctttaaatctttttaaaattttaaaaaatgacaccgaaaaataaatcttttcatatattacaatatgaggtgagataaaaaagtgaatgtgattctaacgccaagagaaaaggaaatctttaatcttttaattaaaaatcaatcaactaaagaaattgctaaaacattaggaattagtgaaaaaacagtacgtaatcatatttctaatgttattcaaaaattaggagttgattcaagaatacaagcggtttttgaattgattaaatttaaggaattagaactttagtaattttaaatatagtatcttggtaaaagctgtgataaatatttacacagcttttatttattataaaatcaacatttagataagctgatatttttattatggttttttgctggtagttagtatataatggaacaaggtgatattatgaagttaaaaagatggcatttatatttaatagtgacgttatgttttataactgcatttgtttcaataaatcgtaaatatgatcgtttttatcgagttaatgggatcaataatgataatcgagcattgatcgaaatgtatttagatgaagacgaacaggaatatctgattgaaaatgcaattgctgtagataagtttattaaatatatcgagattcctgattttaatttaatgtattatgaattttataatgctttagataaaactaataaatatccagatttaaataatttagttagtataggaaatcagttggctgataaattagaggtatcttttgccagtagggcacttacatattgtaatacattaataaaaaataatttagttgatgcatatattaatcaggatacttttgattttaataatgttgatttttatcaaatgttaagatcgatttatgatgaaacagattatacatatataagcgatacaaataattatttaaacacgatgaaggaatatgatgatttagatgataaagaattgcgtgatagttttaaacagttaagtaatgattttacaaagacttcattggcaacactttttaaccatgatctacagcccaatgcaagaagaatctataatcctagtgaaatatcactagtagtaaataatgagacttttattggtggttatgaacctaaaaatttagtagttgcttcgggaattgcaagaactaaatattcgatgtatctgcaagaagaaacttataataatttattagaaatgtatctagcctgttataatgattgtagtaagaaaattattttaacgaaaacttatattagttatgatgtagctcttttggaggatagaggtgttatcgctggttataatgaataccagttaggcagcacggtcgatcttcaaaaaatggatataagtattgatgattttgatcaaacagacgtttttcagtggctcgttaatcatagctatgagtatggttttgttttacggtatcctgctgataagacgcaagtaactaatcatgagtacagcccaaccacatttagatatgttggtaaggaacttgctgctaagttacatgaacaaaatttagtcttagaagaatatgtggtagataaggagtaattagatggaaagagcaataggggtatttgattcaggtgttgggggtttgacagtagtaaattcaattaggtcattattaccaaatgaaaatattatttatattggtgataattatcactgtccttacggtgataaaactccagaacagttatttagttatgcaagtgggatagttgaatattttattgagcaaaatgttaaaatgatcgttttagcttgtaatactactagttcaacagtattagataaattacaggctgtatattctaatatgacaataattggggtgatcgatgctacagttgatgattttattaatcgtaatgttgataatactttaattattgctactgcagcgacaattaaatcaaataagtatcctgatacgatcaagaaaataaatcctcatattacaacttattctttggctacacctaaactagtgccgttagtagaatcaggaatgtataaagaaggaatttatgaagttttacatgaatattttgatgattatgccggtaagatcaaatcgattattttagggtgtactcattatcctattttaaaggaacaaataaaacgagtattaccaaatattgaatatatttctagtagtgaagctatttgtaaaaatattaaagagatcttggaaagcaaaaatttgttaaatacacaacctaataagtatattaaaatatatacgacgggtgaaactgatgaatttagatattcgtcttcaggattttttgattatacagggttaaaagtcgaacatattatcataaaataaaaagttgtttactgctttgtaaataactttttattttggcattttaaaatgattatttcatatgatattattggggggatttaaagatgaaaaagaaattactaataacgattctggtaggtgcttgcttagtgatttgttttatctgtatcaaacatgataataatgaaaaagagcagaaaacagaaaagacttattatcaaacagttgtttttaaagatgatgataatacgttgataccaattgaagtagacatggctcaggaattggaagcagatgataaatatcgaaatatgttggaagtaatgaaatccaaagattatgaatatttgggattacatcctattttagattctaatctccaggtcaatgccatcgccatcaatgataaatcattaacatttgattttagtgacaatttatatgttaataataatcaagaagcattagatatttgcgaaatgttatcatatgttttttgtgtaggagatattgaaaaggttaatttaaagatagatggtaatgatattaatgagcttcccaatagtactataccagttagctgtataactaatcgtttaggaataaataattttgagtcttcaacaaattatttatataaaacgttaccagtagttgtttataatatacaaacaatcaataatcaagactattatgttcccgtcactgagcgcatcgagaccacagaaagtgatattgatactaaagtatcaataatgttaaaacaaatggaatatgaacaacccctatcattagttgagcagtgtactttaaaagatggagatttagaaattcatttagctagtaatattttaaatgataatgagtcaattgataatactttatataatcgaatcgttaaatccgcaagtcatttagatgatgtaaaaaaggtatcattatttattgatgatcaggaaattgagcccgtagaagatgtaaatggcatagtagataatcgaatcaaaatataattttaattttaatcataattgtgtataataagtactggtgatagaaatgaaaaaaatagtagtaatgtctgataatcatggatatcataaaatgatcgatgaaataaaacgtttagagcctgatggagattattatgttcattgtggggatagtgaagcgttagaagaggctttaaaaggttggatatgtgtacgtggtaataatgattggatggcaagattagaagatgaaattatttttgaagtcgagggaataagttttttagtaacacatggtcatcgctatgggtattttaatcgtgaagagctaatggttgatgatttattaagacatggttgtgatgtattgttatcaggtcatacacatgtccctcagtgtgaagaaattgatggtttttatttgatcaatccgggatcaactactttacctaggcgaggtagtgctaaatcgtattgtattatttatgttgaacaaggaaaaattaatgttgagtttaaagaaataatataaaaaatacttgcacatctcttttgaatatgttattctatataggcagtcaggagagatgtctacgtagctcagctggatagagcacacgccttctaagcgtgcggtcaggggttcgaatcccttcgtggacgccattaaaaaaataaagtctaagcaaatagtgtttagactttttttgtttgctactaagtttaaatagactagtaattatgctggtaaattgttgtttatatattaacaatatgatcaataaaaaatagggtagttaatatggaaaatttagataaattatttgaattaatcataaaaattgaaaatgaattagaaaataccgataatggttgttttaatgatgaaatgacattgatgttaaaaattattaattgtgaatgtaactatattgcttcattaaatgatgatattaagatttcaaaaatcaaaatatcattaaattacaactttttgaataaactatgaaaatatatgaaaagttattaaagttcaagaataacttgaatttcaatagctttattttttgtgtttttattggtttcttcactaatatttttaaaattatcttcttttaaaaaaggataattttggaattatattaacttgcatttttattaaatatatgctaatatattaaagcattaggaagcagatgtctacgtagctcagctggatagagcacacgccttctaagcgtgcggtcaggggttcgaatcccttcgtggacgccattagtaaaaaatgcccgttttaacgggtttttttattgcaaaaaaagtgttttaacattattttttaattcctattatatattcatagacaagaaactaatttccaaggagctaagcataatttgttttttactatatttttgtgttttccaacactttttttgtatagtcaaattaagatggtgattgcaataacaaaaatagatatggctctttataaagggataggagcaatattaaaaagaatagctgatattttgattattgattatgctaaagttattcatgaaacaaagacaaattatcaaacgaattcatctctaggagattattatgaaaatatagaatgttttaaagataaaccagatttattgaaattgtataaagagatttgcatactataatggttatgaatatctggtgctcatcaataattgatgcagcagtaaacagcagaagaaaacgactatgcatgaacttattcacgtatttgaaaattatttttcttgtcctaaggaatatgaatattactgtgaaaacaagttcatacaattataaaggaattacagatggaatttatataagaataatgtcgtttatgcaaaaaatggtatttcaagaagttgatccattttttgatagataatatcatatattcacaggagatataaaaatggttttaaaaaataaactcaatataactaattctgtaaaactggcacacattgaagaaaaaacaactaaaaagaaagctttggagttgtttgaaaaaggtattttagatacttttgaagtgggtacttttaaaggcctgtctacaattcacaaatatctttttgaagacatatatgattttgcaggacagatcagagatataaatattgctaaaggagattttcgttttgcgcctgttctttatctttattcagccttagaaagtattgatcaaatgtctcaatcaacatttgatgaaatcattgaaaaatatattgaaatgaatgttacccatccttttcgtgaaggaactggcagaagtacaaggatatggcttgatgctattttaaaaaaagaaatcggttatgttgtggactggtcaagagttgataaaaacgaatatctccttgctatggaaagaagtcctatcaaagatttagaaatcagacatctattaaaaaatgccttaacagataagataaatgatagagagatctatatgaaaggtatagatgcaagctataattatgagggatatgatttatataaaacagaagaattatagaacacccacacaatatagcatgggatcttcgcaaactttcttatcagagttattttagcatagatacaataaaatcacgtgttaccagcacgtgaccaaatgagatattaccagtatctcataaatgtaaagactataccaaaagttcttttacgtactcaattttatcatagagtacaatcatatttagcaaacaatggtgctgatgtttgggttattcctgaacatcttggacatggcagagaaatggttggaaatcgttatttgcatatgtttcctgaaaagcgaaacaagatgaaaaactgctcgactgagtgtttttttgtggtgtaaaaagtgtcatacttttaagattttataggctttttagaaataaataagtagaaaaaaggtacttgaaagtctataaaatttttaattaattttccgttgagaaactatatgatattcatttatatcacataaataaattgactttgaagcaatcgggaagatactgttttatttacttatgtaacagaacgattacttatgaaagtgtaattatcttttttcataaagtagttaataaatacaccatagattaggttaagagtttttctcttaaccttttcgttatcttaatttacagtttttgtgatttataatagaaaatcttacggtcaaataatttttttgtctttattttgccactccacacgttgagcacttgcagccttctgtccaggcgactttagtttcgattcattgctgttttgtaatatccttttgctgtatgaaagatcgaagttgtctgtgcgacccagttatgactatggatcgatgaactgctcttatattttttgaattgcttttagacaaactggataagcttccactagtcgatgtggaagtacggtatttttgacagaaatctcaggtttaggaatcggagttactgtttcgtcatctctaggcagaatttcacagtttctctcgttatatttatcaatattgatatctaactggatatttttctggtgtagataaatcgacattagaatcatcaacttcaacattgtcgatctgatcgatatcactagaaccttctaagatataatgatcatctaagcttatgatatatggactaacatctttttctgttatattcgatatagcattcttatttggttgtttagtatttttgaagaaataaaataacagctaaggcctgatataattataaatatccaaaatattacaataatgttttttatctttaaattttgcataatttcattttctatcgaataaaaatcttttattttttaataaaacttcgattatcagaaatatcttcacgataaacaataaaatatgattcatgttccatgtaatctaaaccaaatccaaaagcaacacttgacgaactccctcttgatgatgatttacaaacatatgaaacaatcgttttagatggatttaatttttttaatgtatcaatatatttaccgccaccagcctttaacatattagttttttcaataaatgtaacttggaatcggtatggataatcattcatcgttttgatgtaggtgacgtttattttttcaagcgttatatgattagcaactagcccgattgaatttcctgtctggatatcacatttaatatttttgattcctttttcattttttagccaatgatttaattcattaatatctgtaaaggaacgcatatattgctggccaacattttttctttggtgattttttataattttattggcaatatattcaatagatttgtcgtaagggtatcgactattttgatcaattggaaatatttttttaccctgcttttttaaaaactgattatatttgatcaaatctttttctgcttgatgataagcatcttttattttatctaaagaagccccttttactttaaaattatgatattttagtacattagatataagcttgttccacaaatcacgatctacagtttcgttactgttatttttctttgtttgtaagtttgtctcattatttttttgagatttgagactgtctacatttctcccgcatttagggcaaaaactcatttcttcatttaaattaaaaccacattttttacaatacataattatttccctctactttgtagctccacacgttgagcatttatatccattgatttttgtttctgtccaggctgctttggtttcgacccactgctgctctgtaacggcatcttggactttgactttttttactgaataagaacttccttcctcggcaatgtgaattgttaatgcttcaccatcaagatttgttaaatctttcccacatccattacatattgttcgatatgtatagatggcatcttgtactgttactgttttgtaatatccttctgctgtatgaaaaatcgaagttgtttgtgcgacccagttatggctatggggcgatgcactgctgtttgtatttttagaattgttttcagatgaactggatgagcttccactggtcgatgtagatggcgcagaggttgcactattttcctcaggcatcttagagtcgggtatcgaagttgctgtttcgtcatctctaggcagagtttcactgttacttgtccagacagtctttccactgttggctaaatcttttgctgtttctgctgctatgatttcaacttctttttggatggtaattgtcttatttgtaatatgggtattgtttttctcattatatttatcgatattgatatatattttatatctaactggatattttcctaatacagataaatcgacattggaatcatcaacttcaacattttcgattatttcattatcaatctgtacatcgtgtaaataatcgatatcactagaaccctctaagatgtaatgatcatctaaacctgtaatatactcattgatatctttttttgtcagtgtagttatcttgtctttatcagtattttttatatgagtatcttccctgttgaaaagaacaaataaaagagatattgataagatgattatacaaataatcacaaatattatagattgttttttatttatttgtaatattcttttcatttttcaacctccaatacatttataatactggaatatttactaaaaatcaaatgatcatatgttttgaaacacgtaaagctataatttttaaatctgttttgcttagaaatgattaaaagtttagttaagatgaaaatacgtggggtaataagctgaaaggaaagaataatatttgtaacaaataaatagagacagcatataaataaattaggagatgaggctatggaacaatcatgttaccttgattggaacacgcaggtatatttgaatgagtatcagtgtattctagcgcaaatgattgaaaagatgacttctgtacaattatcatgcagtatttctcataattttattgttcagatgattccccatcatcgcgcagctattttaatgtgttgtaatcttttaaaatatacgaaaaatacttatttacaagaactggcttttgggattattagagatcagacaaaaagcattgagaatatgaaaagtattttatgtacttgtcaaaagcagactaattgtaaaatgcacttagatcaatatcaagatgagatagatgcaatcatgcaaactatgtttatcaaaatgtcggaaaaatcttttaataataatattgatgttaattttattaaagagatgattcctcatcatgctggtgcaatagcgatgtcaaaaacagctttgaaatacgatatttgtccaggattgaggccgatattagaggcgattattatgtctcagtcaaaaggaatccaagaattggagactttattaagttctcttactattgaaaatcacaattgtgaataacttgtggatattgtgataaaatgacgattattcgtcatttttatatgatgcaggatcttgctgatgatagacaagtttggaatattcgctgggggttaggttgaattgctgcttaaatgctcttgaaaaatagtgaatggaactaaatcctaacatataggcaatttctgtaatcgtatatttattttctaatagtagttctttactgcgttttaattttaaattaataatatagtttttaggggctttgttgatattggctttaaaaagggcttgtaaagaacttcgggaaatagagaaatattctgtaatatcttcaattgataatggtgtattaatattattgttgatatatgctattatttgtttaaataaattgtcttggtatttttgaatgtttggaagtttggaatgctttttttgaaattgattatcttgcaatagatggatgattacttcctggagatagcataacattaatgttttagaataaatattttgtttatcacttgttaaggataatttatttaataagttgcgtaaagtgtcattaaggtgaaaaacagtatttaataattttgaatcatcagcaatcgacatttcaaaaagaatcgttaaataagagcaggtttgattactattaacttgttgtttatgaaattgatttgggccaaagatcattaaatcattgctttgtagtgtgtaacaggtatcatcaatataattatcaaggctgccatgatcaatgaaagtaagttcataaaaattatgctgctcaccttcaaaataatatttaggcttttttatattataataacagccaattatttgcgggatcgataagattgggacgattggctggtaaatgtatggtttcatgagatttaaagcaataaatttagcgttatttgggataattaatttaactgttgtttttttgttatgaggaataatattaaaaaattgaaaaggtttaataagtaaattgaggcgaatagcaaatagttcaaaatctcttaaatttttgctgattacgatatttgctaaatcagctgattcaatacgtacttgtttgttgcaataaaacatggcagttaatatttgactagataaagaaatttctttatgaatatatttatttttagtagtaaaggggtcgttatatattgatccaaattcttgaaattggatatttgtagttttgctaatcatatatccacctcctcttactattttagtataaaaattgataaaaataaatcaaaataataaaaaattatcgaataaataaaaatgacggaaattccgtcattaaaataaaccaagtaatgcctgcattgataaacatacaacagtaatcgccatccagcagctaaaaccaagtagtattggtttaccaccactttttatcaattttacaatattagtatttagaccaatagcactcattgccatgatgataaagaatttactcaaatctttgattggtgccgtaatactaacaggtagattaaaaacagtagtaataattgaagctaggacaaaaaataaaataaagtaaggaaaaatcttttttagatcaactttgctactttttccattatcacgagtacgtttaagcgctagaactaaagtaattggaataatcgctaaagttcttgtaagtttaacgatcgtagcatggtctaatgtattgctgccatgaataccatcccatgctgtagcagtagcagtaactgaagatgtatcattaacagcacttccagcgaataatccaaaaccatcgtttgataatcctaagagtcctcctaaagttggaaaaatcaatgccgcgagaatgttaaaaagaaagattacagaaattgcttgagcaatctcttcatcatcagcttcaattactggtgctgtcgctgctacggctgatccgccacagattgaagagccgaccccaatcaaggtagctatctttgaaggtatttttaacagtttacataaaacaaaggcaactactagtgaagttgtgatggttgaaaggataattggtaatgatgaactgccgatttttaagatgtcttttaagttcatcccaaatcctaataaaataactgcatattgtaagatctttttagaagtaaaagtaataccctcttgaactttacttttatcttttaaaaagcaggtaatgatcattcccattaaaattgcaaaaactggaccaccaactaaagggaacattttacctaaataataagcaggtaaagaaataattagacataaaactacacctaaaaagctatttttaattttaatcatacaaatctcccttctgatcgctaatattatacatgattaaaacaataaataaaaattatatatatttatataacgataaaaaaatgttattattaatcggggtgataaaaatgctggattttagaatcgatacatttttagctgtatgcaaattcatgaatttcactaaagctagtcaatatttgaatattacacaaccggcagtatctaatcatattcattatcttgaaagttactaccagattaaattattttattttctaggtaaaaagatgcaattaactgatgaaggaaaaatcttattagaatatgcccgaactttgaaacatgatgatatctttttaaagagaaaatttaatgatatgaaaatgaaacaagaattgatttttggagcgacattaacagttggagaatatatgatgccaaaagttattgataattttttgagtaatcaagataatatggtgctaaaaatggaagtggcaaatactaaggaattattaaattatattaatgaagggaaaattgattttgctctagtggagggatattttaataaactggagtatgattatctatattattgtaaggaacagtatgtatgtgtagcggcaaatgatcttgaaattgatgcagttaaaaatataagcgagctttttagctataatctaattattcgcgaaactggttcaggctcaagagaaatacttgagcggtatttaggagaatgtaatttaagtattaatgattttattaatttgattgaaatcagcaatatcaatacaattaaacagctagttaaaaataatcgtggaataacttttatgtatcgcattgctgttgaaaaggaaatagaattaggtttattaaaggaaataaaaatagctgatttatcaatggaacatgatattaactttgtttggcgaaaaaatagtgtttttgttgattattatcaacagttatttaaattgttttctaaatagatcttatgataaatcgtttacatcgaggatatcaacatatatgcaaatggcatatacccaaaatgattttgagtttatagcttgcttttttatatacaattttatgatatgtaatgagaatttttttgatatcataaaagcatctagaaaagaagggaaaaagtgttatgtttgaaattgaaaacaataagattggaaactatatttcaagtttaattactaataaatttgattcagcacgtagtttttgtagagaatatttaaaaataagtggtgaaaagatcaatgtggtgaaaagatcaatgaggatacgatccaaaatgtggcaaatcgtcttttacaaattaaaaggggacaaaagcaattcaaatttacgatctacctattttttctaagttacttgatgtttcttttgaacaaatacttagtgctggaagttgtggcgttcaaaaaagtaaaagagtaacaaattatgctattgctcaattacataataaaaagaatgacttgcttatataaaaagagatgatgagctgattcttaatgttgacgaatataaaaaacagtacttgaagatgctattgagttcaatgattatgattttataaaagttcttatcaataataaatatatttggtttgatagtggcgatagcaatgactataggcaaattttggggctggaaccagtatccccaaaccagaatttgaagaacttggtaatgggggttacgttatataccaccaattgatttataatcgcaaatcaggtcagaaaaagatcgattaagaaagcaaactattgcacttgctgttgataatgatgatttaaaaatgttagaaaagctaagagcaagagaattaccacaattatatttacaagtaaaagggcattgttaggttttattataagaggagtgttagtgatattttatattactactagggtaaacttatttaacagaatttgatagtttaagtgttggatcaagaatttatcaattttcgataaattctttttgtattatcttttttaaaataaataattgacttgttgaaaaagatgatattgattttatttagcgagaaaatagtttttttgttgatcgttatcggtaattgtttagccggtcaaaaaaataaattgttttcattgcaaaatatttacggcttgttataatagtgttttgaggagtgatagttatgcctttgacagatgatgatttttttaatgatagtaaattggaactttataatgaagtaattaaaagtttacatgaacaagaagatgatggtactgaggaacaggagtatcagcttgatttagaagatgaagagtaatgatgtatctatgatacatcatttttgaggagaatgtatgattgaagaatatattgctaatagtcagtttcaagatgcactagagctgcttactgatcttgatgacgaaatggttcgctatcaaagattagtatgtttatacggcttaggtgaatatcaggcagctagaagtgaaggcgtgctagcaaaggcaaaagctggtaatacatattatgatgttattagtatttatgttgcagttttaaaagagttagaggaatttgaagaggcaatcaatattattgttgaagaactgtcgatgccttatattccttatgaatatgagagtgtttttaatgcggcttatgatgagcttttattagctaaaagagaagctaatgaaggaatggaacgtcataataatgcttttagcttagaagatatggaaaatattttaatgaaagatatcttaaatgaagatcttttatatatggcaatcgaacaaatggaaggaatgaacattcgccgtcttttaccagcaatcagaagatttttaaaagatgatgataaaccggcttttgctaaaagcctgttggttgaattaatgatcgatcaagaaatcgatgaagaaatgattcttacaaaaaatggaattgaatatgaaattaatcctagttatgcaccgttagtattgaatcaagaagttggtgaaatgatcttagctttattaagtgaggcaatcgaagatgaaaatccatctttatttaatttgtgtgagcagtttttaaatttttatttatatttgatatatcctaagtttattgatgaatatgattatcgatcaattgctggagcgattcattatcatttggcttcgatgcagtatattgatctagaattagatgatgttgaactgctttataactgtgataaagaagaaattttagaaaaattaaatgaaattaaacaaattgaatattaaagtcacaaaaattgggatattaatgttcaaaaaagttgaattaatgaaattgttagtatataatacgtgatgaaactaaagaaggagaattgtatgaaaatcaataataaaaaattagagaatgccatcgttgaattaacagtagcattcgatgtagaagaatggaaagaaactcaaaaaaaagcattagacaaattagctaaaaaagtaaaaattgatggatttagaccaggtaaagcaccagttgcaatggttaaagctagagtatctaaagcaagtattttagaagaagcgactgatatgattttacaagctaattttgttaagattttagatgaggctaaagtggaaccaattgcacagccagctttaagtattgataaggtaagtaaagaagaattagaagttaagatcttagtgccagttaaaccagaagttgaactaggtgaatataaagggttagaagttaagaaaactcgtgtaactgtaactaaaaaagaaattgaagaacaattagcaaattatcaaagccaatttgctgaattatctgtaaaagaagatggtaaagttgctaaaggtgatacagcagtaattgattttgaaggatttgttgatggtgttgcttttgaaggtggaaaaggtgaaaattatccattagaaattggaagtggcgcatttattcctggatttgaagatcaattaattggaatggggattgataaagaacaagaaattaaagttactttcccagaagattatggagctgcagatctagcaggtaaagaagctgtgtttaaagtgactgtacatgaaatcaaagaaaaacatttaccagaaatcgatgatgaattagctaaagatgttaatattgatggagttgaaactttagatcaattaaaagatcatattaaagctaatattaaatctcgtaaagaaaatgaaaatgaacaaaaattcatggatgatatctataacacattaattgaaaattcaaaagttgaaactagtgaagctttattgaaccaggaacaagaaatgatgttacaggaaattgaacaaaatttacaaagacaaggtttaaattttgaagtatatgaacaattcactggtaaaaataaagatgctatcaaagaagaaatcaaacctcaagctgaacaacgagttaaaataaatgcaattcttgcagcaatcgttgaagaagaaaaactagttgttagcgatgaagaattagaagctgaattacaaaaaatcgcagattattataaaaaggaattagatgaagttaaaaagatttttgaaggaaatatgagccgaatcgaaaatgatattttaactcgtaaagctattgatttagtaaaagacagcttaaagaaatagtgaaaagagacgctcacgcgtctttttgtgaaataaaagataggaggaagtaaagtgaacgaacagactgtattaaatttaccggtagtttgtactcgaggcatggttgtttttcctgaaaacaaattgaccctagatgttgggcgtcctatgagtttaaaagcgcttgatttaagtactaaagagcatgataacaacattatttttgtctctcaaatcaatcctttagtggataatccttcttttgatgatgtgtatcatataggtactgtttgtaaaattgatcggaaagtacgtcgtgacagttctggaacggttaagttgacggtagttggtgccaaaagaataaagttagagaattttattgaaaaagaaggaactgtttatgcaacagcaactattcttgaagatgaatttggtgatcaaaatgaagaagtagctttagttcgtaaaacaacttcttattttgaacaagcaagaagaagtatgccaaatatgccgcttgattcgatcaatcgtttaactagtggtgtatcggctagtgttttagcggatacgatcgggcaatatttgccagttgattttaaacagaagcaaaaaatattagaaactgttaatatcaatcagcgtttattattagttataagttcaatcgaatcagaaaaagtaattggtgaaattgaagaaacaattaaccgtaaagtacgagaaagtattgatgaaaatcaacgtgaatattacttacgcgaaaaattaagagcaattaaagaagaattaggagatagtgttcctaaagaagacgatgctgaagcaattcgtgaagaattacaaaagcatccttatcctcaatatgtcaaagataagatcgaagaggaattaagaagatttgaaacgatgccagcagcttcatctgaagctaatgtagtaagaacgtatattgactggatgttaaaagtaccttggtatcaagaaaccaaagatgttgaagatattcaaaaagttgaagatgttttaaatgctgaccactatggtttggaaaaagtcaaagaaagaattgttgaacacttagctgtaaaacaaatgacgcaaaatttaaaagcgccaatcatctgtttagctgggccaccaggtgtcgggaaaacatcacttgctaaaagtattgctcgagcattagatcgaaaatttgtcaaagcctctttaggtggggttaaagacgaagctgaagttagaggacatcgtcgtacctatttaggatcaatgccaggaagaattattcaaagtatgaaaaaagctggagttgtaaatcccgttttcttattggacgaaattgataagatgtctagcgattataaaggtgatccaactagtgcgatgctggaagtacttgatcctgaacaaaatagtcagttttcagataattatttagaagaaccttatgatctatcaaaggtattgtttattgcaactgccaatgatttaggaaatattccggcaccattacgtgatcgtttggaaattattgaactttcttcatatacagaacaagaaaaattgatgattgctaaaaaccatttaatcaagaaacaattagtaattcatggtttaaaagcagaacaattagtttttgaagatgatgctttaatgaaaataattcgtcattatacacgtgaagctggagttcgtgatttagaaagattaattgctaaagtttgccgtaaagcagttttggttattttaaaagataaagaaaagaaaattactgttgttgccagtgagcttgaacaatatcttggtaaagcaccatttgaacatactaagatgttagatcatagtgaaattggggttgttaccggaatggcatatacgcaatttggtggcgatattttaccaattgaggttaatcatttccaaggttctggtaaatttattattacgggacaattgggtgatgtgatgaaagaatcagcgtcaattgccttagattatatgaaagctaataaaacaagatatggtcttgaggaaattgcttttgataaagaagatattcatatccatgtgcctgaaggagctgttaaaaaagatggacctagtgctggggtaacgttaacgacagcaatctattcagcatttaagaataaaccagtgcgtaacgatgttgcgatgacaggtgaaattactttaagaggtaacgttctaccaattggtggtttaaaagaaaaatcgatttctgctcatcgttcaggaattaaaaaaatcattattcctaaagataatgctaaagatatcgatgatattccaaaatcagttcaaaatgatctagaaattgtcttagctgatcatattgatacggttttagaacatgcacttgttaaataaaagggttaaaaaaattaaccctttttcttatcttgtggtacaatagaaaaggtgatagaaatggttaaaataaaaaaagcacagtatgtcctttcagctgcctggaaaagtcagtggcctcaggaagaatatcctgaaatgtgtttggctggtcgtagtaatgttggaaaaagcagttttattaatgcaatgttaaatcgtaatggtttagctaaagtatctagtactcctggaaaaacaaaaacattgaatttttttaatgttaatgatgctttatattttgttgatgtgccaggttatggttatgctaaagtaaacgataatgttaccaaacagtttggtaaaacaatggatgaatatattgctatgcgatcaactttaaaaggttttattttattagttgattatcgtcataaaccgactaaggatgatataacgatgtatgagtttgtaaaacatcacgatcttccagtaatggttgtggctactaaggaagataagctgaaaagaaatgatttaaagaaaaatgaaaagattattaaagaaacattaggatttcatcctgaagataaatttatccgtttttcaagtttgaagaaaaaagggattgaagaagcttggaatgttatctatgaattatgtgatcttgattttaattagacagtttgactgtcttttttcatatttttatattttttgcatatagtttgatgggaggtaaatatgcaaaagatatattttgaaaaatgggttgatttgaatcatcagttaaaagagttattatcattatcagttgatgaatcgatcaactacaaaattgaaaatgttggtgttagagcgataggaagtttgattgtaaaaggggaatataacgaaaacaaaaaatttgaagaaaatattgaaatggatgttttagctacttttgataagatcgttgatcagcgagattttaatattaaagttgaagattttgattatttcattaaagatggtgatgttcaaattaagatcgaagttggaattcatggagtagttgaaggtgaagatcgctatgtaagagatgaaaatttcaaaaaagaggatcctttagaagaaattgaaaacttgattcgtgatgaaaaaacgacggaaacagttatgccggtaaaagaaccagttagagaagagataaacgaaaatgaagtagttatggaaaagacggtaaaacaagtagctccagtaaaaaatattgagaaaacagaacctgtttatcaagaggctaaaatcgttgatgctacaatgattccagaaactaaagaagctctggttaccaaggaggcagctatagctgaggaaatcagcgaacaattacaagaaaaagtttatccaagcaaatcacgaccaatcttccaggatacagctgatagtgtgggaacttattatttgtatattgttaaagaaaatgatagttacagtgaagtagcatcccgttataatgtcgatgaaaatgcaattcgtgattataatcaggataaagctttacaacccggcagtgttttaattattccttatgtatgtcaataaagtaatcgaagaagcttattcactagaggtcattggttatattaaagtatctaaaaaagtatataaagtaaaatgtaaagaaggatttttttgtttaaagtttgttgaagataataatttatctgtcgtattggatcatatagagagtttacatttgaagtgttttttacctgtaattaaaaattctcatcatcagatattaacaacgtgtgatgataaaatattttatcttagtccctggttagtgaatgataatgcaatcataaaagagctaaaattaaaattttattatgaatgtctagcttatcttcattcgagttctttttttaattatagtgtttcaaagagtttttttaagcgccaaattgaagatatcaataaaattattcatgaacgacaaagatattatagtgaattgatgaataattttgaggttttatcatatcgtagtcctacaggctggatgtttgttttaaattatcagcgtattgaagcttgtttgcaaaatgcgttagaatttttaggaagttatgaaaattatgtatgtaatctagatacccttagattatgtttgacttataataattttaattatgatcatattatgatgaaagaaagtaaattgatttctatcgatcatattaaaattaatttatgtatttatgatatttataatatgtatcaaaagataccagaacttatatttgattttgatgtgatcttagatagttatttttgtaaattaaaattattaaaggaagaaagattattattacagtgtttacttcatgttgttccgataattaaactaggacatgatgaagttaataatatcattatgatgtcaaggctgctttattatttagattcaatttcttcattgaataaaaagctttcaattgactagtagataagattttgttagaatggttttagcaatgatcaggaggagtagatcttgatgcttgatagagagtccttgagggtggaaagaggataagataagagtttgaaggtagcctgggagcatgtttattgaaggttagtagataaacacgtataactgcgttaaagtttagaggcataaaattattatgcaaagtaaggtggtaccacgagcattcgtccttatgacgatgcttttttattttaaggagaaaattatggcacatacagttgtttggggcttgtttatcgcagcgtgtatttttttattgattttatttggtaaaagaatatttcagatcaataagctgcaacgaaacaagcgtcgtgaatacgagcatgatcgtgttaaatatcgtcattttacaagtgaaatgtttgatgaaactcctgatgataagcttatttatgctgttatatatcatataatggcaaaagaagataaattatatgaggatgaaaaaatcaatggtactttaaaagatgttttaactcatggtgagttattggtttatacaatttttcaagttgaatcttcaatggaaggtagacggggtacgatacattcgtttttcattaacgagccgtattgtctttatcgtccttatctaaaagaagcttttgaggcagttggctgttatgaaattgctgagctgctggcatcggctgaaaaattagcattgatgattgaaaatgatgaagaaattgagatagatgatagtgattatggtcggtataattttgctgattatacaaatgcattgatgtcaatgctgaaagcttcagaaattatattaaaaacaggtgaatttatcagaaaaaacaaaaaagattttattgatatggaggtagttagtgatgagtaaacaattagaaccaaaatataatcatcgtaaggttgaagaaggaaaatatcgtcattggatcgataagaaatattttgaagcaggagatacgagtaaaaaaccgtatgctattgtaattcccccaccaaatgtaaccggaaaattgcatttaggacatgcctgggatacaactttacaagatatgatcatccgttataaaagaatgcagggatatgatgctttatggcttccaggaatggatcatgcgggaattgctacccaggcaaaagtagaagctaggatgcgtgaagaaggagtttctcgttatgatttaggacgtgagggatttttagaaaaagcctggtcatggaaagaagaatatgcgtcaattattcgctcgcaatgggaaaaattaggattatctctagattattcaaaagaacgttttactttagatgatggtttaagtgatgctgttaaagaagtatttgttaagttgtataatgaaggtttgatttatcaaggaaagagaattattaattgggatcctgttcaaagaacagctttaagtaatattgaagtaattcataaagaaattgaaggcgcaatgtattattttaaatatcagatcgttgatagtgatgaacaattgatcattgctacgacacgacctgaaacaatgtttgctgatcaggcaatttttgtccatcctgatgacaaaagatatacccatctagttggtaagaaagctatcaatcctgctaatggagaagctttaccaatcatggcagatagctatattgatatgtcatttgggacagcagttatgaaatgtacacctgctcatgatcctaatgactttgcattagcgaaaaaatacaatttagatatgccgatttgtatgaatgatgatggaacgatgaatgaattggctcataaatatcaaggaatggatcgttttgagtgtcgaaaagctttagtagctgattttgaagctgcgggagttgttgatcatattgaaaaacatctccatcaagtaggacattcagaaagaagtaatgcgattgttgaaccatatttatcaaaacaatggttcgttaaaatgaaaccgttggcgaaagcggctttagataatcaattaaaagattctaaagttaattttgtacctgaacgttttgaaaaaacattcaatcaatggatggaaaatattgaagactggtgtatttcccggcagttatggtggggtcatcaagtaccggcctggtatcataaagaaaccggtgaagtatatgtaggtaagagtgctcctgaagatattgaaaattgggttcaggatgaagatgttttagatacctggttttctagtgctctttggccattttcaactttgggctggccaaatactgatagtgaactatttaaacgttattttccaactaatacattagtaacaggttatgatatcattttcttctgggtaagtagaatgattttccaatcactacattttactgatcaaagaccgtttgaacatgttttgattcatggtttgattcgtgatgaacaaggaagaaaaatgtctaaatcattaggtaatggtgttgatccaatggatgttatcgatgaatatggtgctgatacattacgtttcttcttgacaactaattctgcaccagggatggatctacgctatataccagaaaaacttgaagcttcatggaattttattaataagatctggaatagtgcaagatttgtcttgatgaatattgatgaatcaatgaagtatgaagatctttcatttgagaatcttaatttatgcgataaatggattttaaatcgtttaaatgaagttattcgtgaagtcgatatcaacatggataaatttgagtttgttaatgtcggaagtgaattatataaatttatctgggatgatttttgttcttggtatattgaacttactaaagttcatttaaacagcgataacgctatagaaaaacaggctagtttgaatactttagtttatgttttaaatgccatcgttaagatgttacatccatttatgccatttgtaacagaagaaatcttccaggcaattccacatcttgaagaatctatctgtattgcttcatggccaaaagtaaataatgaatttaatgatgcgacaattaatgatcaatttacatatttaattgatattgtaaagggtatccgtgaaattagaacgcagtatacaattaaaaatgcagtcgaaatagcttattcgattgcgacaaagaatgcagctttagaaacattgatgaatcaatgtttgccatatattaaaaaattatgtaatgctcgttgtcttggttataatcttgatgctgatggtgaagtagctaatattacgatcaagggcggaaattcattattggtagaattaggtgattatattgataaagaggctgaaaaagaaaaattgttggcacagttaaagaagcttgaaggtgaaatcaaacgttgtcaaaatatgctttcaaatgaaaagtttacatctaaagcacctaaagaaaaagtcgctttagaaagaagtaaattagctgattatcaatcaaaatatgatgctgtaaaagaaaaattagcgatgatgtaaaactgttgaaattttcaacagttttttttcataaaaaaattattttttgaagtaaaatcaataatttgagggtaaataataataagaggtttaataaaagtgtggggttagataaggaggaaatgaaaaatgaacgaattacaattatgtagtcagatgcaaatttctggtggtggatttacaactattttcttttgtgtggttatgggtgctgctgtttataagatggcaaagtcaacggctggaagagtatcgatacctagaattatttcaattgagtggcgttaaaatgaaagaattgcctgttgcatcacaaaaacaagtcagtggtgggtttgctttaccttttattattacattgattgctgttagcggagcagtcaatgtagcaagagtaataagaagtcattattcggttacgagaggtcgttaatatgaaaggctaaaaagcctttcatattttataactatatgcatattctttattggaggtggaatatgaaggtagttaggttagttgttgtcgtatcaatgcttttatcattattgtttggaggattttatctaaagtttttttcatctattcaaagtaagatcaatgcttacatagtgcaggtaggaatttataagcaggatgaaaatgccaatgaaatggtagcaaaattaacggaattgcagcaaccgaattataagtatcaaaaagataataattttgttgttattactggaatatttttagatgaagaggaggctaaaaagatgggaaatacaattagtgaaaagggaattacctgtgtgatcaaacaagtacaatttgatagtagttttaaagaagttattgaacagcaaaattatgaagccatcattaatgagctaggatcatgaaaataaaaaattatccccaagaagaacgaccacgagaaaaagcttattattacggaattgaaagtttgagtaatgttgaattacttgctttgattttacggacaggtaataagcaggagtcagttttagagttggcgcagcgattgatcaatgaagttgggggcttagcttatttaaaagatataacttatcatcagcttgttttgatcaagggaatcaagaaggctaaagccattgaaatattggcagtaattgaacttacaaaaagattaagacaagtacaaggaatatcgtcagttattaaagaaccgatcgatggttataatctcgttaaagataaattgatgtttgaacaacaggaaaaagtaataattttatgtttgaattcaagattagaagtgatgaaggaaaaaacagtatttattggaagtaacaatatttcaattattagtggacgtgagctatttaaagaagcactgatatgtggcagtagtcgaatcatggtgattcataatcatccttcaggtaatcctacaccttcatcagaagatgttgaaacgacgaaacgtttatataaaatggctgaagaattggaaattgaagttatcgatcatttaataattggaagaaataaattttatagttttgcttcaaaagaaattattgaagtctaaagttaattgattattttatattaatgccttataatggtatcagcatgtgaggtgataatttgaataatcgaaagaaacaacgaaacagaagaatcattttgataattacaattgcaattattgttttttcaagtatctcattaattttttcaagaacacaatggggaattgaaagaatgatcagtgattcagtggctgtagtagagtattatgtgataaaaaaaccaattgagtttgtaagcggcttatttagtgaatacaatgaattaaaggatgtttataacgaaaataagattttaagagctagattagcggcttatgcgagtgttgaagttaatactgatgttttatcaggggaaatagatgatttgaaaaaagctttagatcttagtcatttaccaactgattataatgtaaagacggcaactgtcattgctcgtgatgccagcagctggaccaatgaaataacgattgatttaggaagtatggctggtgtaagcaaagacatggtagttgttgcttctaaaggaatggtggggaaagtaacttcggtaactgaagttagtgctactgttcaattattgacaacggaaaaacctgtttccgatttaccagttcaaattatgaatggtgaccaaaatgtttatggtttattaaagcgttatgatgttgaaagtaaatgttatgaggtaacattattgagtgatgtcgataaactagaagataatgctaaggttattacttctggcttaggtggtgatcaaaaagcccctaaaggaatttacataggaacagctgaggttatagatgtttctaatgatggtacaaccaagacccttaaagttaaaccggctgaggattttagtgatttgagttatgtttcagtagtttttagaggaaatgatgatgaataaaaaattatatcgttattatttagtaatggcgcttagttttgtaattgatagtgttatcaattattatcttccttttaattttgataaatcgggaatcacaattataccttgtattggtttgatgatgtttaccttgttgaataatactattggtgatgaacatcgctatatttttgcaacggtaacagggttgtattatgcaatcgtttatgctaatagtttattaatatatgttttactgtattgtttatatgcttttttaggaaaaaaatatactaaattagcgacttttacccttttagaaatgtatatcgctgtaattgtgacaataatcgcgcaagagatcgtgttatactggttagtgtggataacaaatattacgcaactttcgataataacttttatgataaatcgtttgttgccaactgtagcggttaatttatttttaattgcaccagtatattttatccataagaaattaggattcgagggtaagatcaatgcatatcaaagtaaaaggggttaatggtcatctagtttttgtttttgatgatagtcaagaatttaatagtttaataagtgaattaaaaagtcttttagagtctccattacttaaaagtgatggttattatccaaaggctttttttgattttaaaagtcgaattttgagtattcatgaattatcaaaattattagaactattatttgaaaaacaagttttgttatttgatggcattaatatgataaaaaaagaacataaaaataagatcaaagtaattgaagagacgattcattcaggtgaggttttagaattagatcaagatactttgattattggacagataaatcctggagcaatcgtgcgttttagcggaaaattatatgtgatgggaaaagtgtgtggttttgttgagggaatgaatgctgatgcgaagatcagtggacaatgttttaaaaatgctcatgttagaattaatggagtatctcgacaaaattatacaagttttgaacttacgatgctttattataaagacaatgaaatattcttagataagggggacatgatttatgtctagagttatagtagttacttctggtaaaggcggggtaggtaaaagcagtataagtgtcaatctggctagtgctttagcgtattctaaatttaaagtttgtttgattgatggtgattttggactcaaaaatttggatgttatgatgggtttagaaaatagagtagtttatgatttaaatgatgtagttgaaggtcgttgtacaattgaacaggttttggttaaagataaaagaatagctggattgagtttattaccgtcgtgcaaatcattatcatttgaaaatttagatacaaagataatgaattctttgattgaaaggttaagtaaagattttgattttattattgtagacagtccggcaggtgttgaaaaaggatttgaatattcagcatcgttagctagtgaagcaatcgtagttgtcaatcttgatgtatcatcattacgtgatgccgatagagttgtggggctattgatgaaaaaaggtattaatacgatcaatatggtagttaataaagttaatcttgatgatattgaaagttctcgttcgttaacgatcgatgatgctaaagaaattttatcattgccgttattgggaattgtatatgatagtcatgatatgatagaagctaataatcgtggtgtaccgatctttttagatcagcagcacttattacatacatgctttttaaatatcgcaaaacgtttattaggacatcaggttccatatgtgaaatataaaaagaaaagtttaattcgtcgatttttttattcatgatctaagtctttaatataaattgttatcatataatgaattaggtgatatgatgaatgatcttgatgatgtaagaaaacgcatgcataaaaggcgtcaaaaacctttaaatgatgataattttaagcggttttataattttatggttaaatttatggtcgtgattttagtggttttagtttcgatgtcgtatgttaaattaaaccctgattcaaatctaaagaaaataattttaaatgatgctaattataaaatggttaccagctggttatcagatacgctattttcgtttttaccttcaaatgagaccccggtatctagtgaaatcagttatcagcatgtaaaagatgattactataaaaataatagtgatgaggttttaagcattgaagcggggagagttatcgaggtaggaacggatgaaagtttaggtagtcatgttgttattttaggtaaaaataatgtaacgatcacttatagtgaaatcgataatgtaatggtgacattgtatgatgaggtagatcaagggatggttctaggaagttataatgaaaagtttattttgcagtttgattatcttggtaaagagataagttatgaagagtatcaaaggatggaataactggtatatccatccttttactatgatgtatatcttgattagtattataaataataatttctttaattatattagtgctttaatgattgtttgtattcatgagtatggacattattattttgctaaaaaatttaattttgaaattgaaaaagttgagatatttccttttggggcttttttaagtgtcaatgattatggaatgcatcatgtttgtgaagaattgatcatgttgatggcagggttatcagtacatttacctatttattttataattgaaatatttattcaaaatcagtatttattagaagttaatcgtttggtatttatttttaattttttacctatttatccattagatggttctaagatcttactgcttttattgtctttgatcaaagattattatcaagcaatcaaattacaaataaaaatatctttgtttgctttatcgatattaatcgtcttatataacaagattggttatttgctggtgtatttttatttactgtacgctaactatgaatatattaaagaatttcgatatatgatcatccgtctttatttaaaaaggatgcagggtagtcagtataagcattgtaagatcaattataattttaatttttatcgaccttattataatatctatgtaattgatggaaagacatataatgaaaggcaaatgttacaatttttaataaaaaagctaaaaacagattgactttagggcataaatttaatataatgcaactgttgtagacctctagctacaaccgcacataaaaggtattaaagcaatgctgccttggttggcgagtcttagaatatttataggaggtgcgatatgtacgcaattattgaaacaggtggaaaacaaatcaaagttgaagctggagatactatttttgtagaaaaattagatgttgaagcaggagaaaaagtagtttttgataaagtattattagttggtgataaaactactaaattaggagctccttatgttgaaggggcaactgtagaagctactgttgaaaaacatggtaaagaaaagaaagttgttgtttataaatacaaccctaaaaaacattatcacaaaaaacaaggtcatagacaaccttatacaaaattagtaatcaatgctatcaatggataatgatcaaagtattaattaaaaaaaaagaaaatcaaatcattaatttcaaaataactggtcatgctaatagtgatgtttatggcaaagatttagtttgtgcaggtgtttctacaagtagtataggaacattaaatatgctagttaaaaaaggatttttagatgatcatattggaacgatcgaagttaatgaaggatatataaacataatcgtaaaacaagtagatgagatttgccaagtggtgctagagacgcttgagacaactttggatactatggctgaagattatggacaatttattgaaatatctaaagtggaggtgtaacatatgatgttcaaattagatttacaattattcgcttctaaaaaaggggtagggtcaactaaaaatggtcgtgattctagatcaaaaagattaggagctaaattagctgatgggcaattttgcacagcaggatctattatttatagacaaagaggaactaaaattcatccaggtactaatgtaggaaaaggtggcgatgacactttatttgctacagttgatgggatcgtaaaattcgaaagacttggtagagatagaaaaaaagtttcagtttatccagctgcataatttaatccctgaaaagggatttttttgtatcgattggtaaataataagaaaagaggtggatttatgcaatttattgataaggcaaaaattagagttgaagccggtaagggtggtgatggaacagttgcttttagacgtgaagctcatgttcctaaaggtggacctgctggtggtgatggaggaaaaggtggtagtgtcatttttgaagctacaacatcactttcaactttattggatttaaaatataatcgtttatataaagcgccttcaggacaaaatggaatggctaaaaaaatgcacggtaaagatgctattgatacgttgatcaaggttccggttggaacagtaatcatcaatgaggaaacaaatcagatcatggcagatctaactgaagataaacagcgtgtagttattgctaaagggggtcgtggtggtcgtggaaatgcccgttttgcaacttcaagaaatccggctccgcaaatttgtgaacgcggtgaaccgggggaaaaatttgatttacagtgtgaattaaagttattggctgatgttggattagtaggttttccatcagttggaaaatcaactttactttccgttgtttctagagctcgtcctgaaatagcagattatcattttacaacgatcgtaccaaatttaggagtagtacaggtaaaagatgggcgtagttttgtgatggctgatttaccagggctgattgaaggagcagcgcaaggcaaagggttaggacatcaatttttaagacatatcgaacgttgtcgggtaatcgttcatattattgatatgggagctgttgatggtcgggatccgtacgaggattatgtgacgataaataaggaattaggtgaatatcagtatcgtttattagaacggcctcaaatcgttgttgctaataaaatggatgaagaaggggctgaagaaaatctagctcgttttaaagaattagctggtgatgaagttaaagtttttccaattagtgctatcatccatgatggcgttgaccaagtattatatgcaattgcagatactttagctgctactccagcgtttacactggaagaaagtgacgaagaaaatacagttctttatacaatgaatgatgaagaagaaaaaccatttgaattacataatttgggtaatggaaactggaagatcactggtaaacggattgaaagaatggtagcgatgacttcattagtaagtgatgattctttaaaacgtttattgatcaaattaagaaatatgggtgttgatgatgctctaagaaatgccggagctaaagatggcgataatgttgctattgcggattttgaatttgattattatgagtaatcaaattatcattttataatgttgaggctaaataaaataattaaccagattattttgtttagcctttttattatttgtcgaaaaagttagaaaaataaaagaagtgttttagatataaagatggtataatgatatggaaagggtgatagcatgggaatatatttaaatccagggaagatgtcatttttacaggcgacaaagaatccaatatatgtagataaatcattactgatagaatatactaatagtttgatgggaattaatgattgtaagatctgtgtttcaagaccaagaaggtttggaaagagtaccgatgctaatatgttagtggcttattattctaagggctgtgattcatcggatatattcaatgatttaaaaataagtcaaacagaattatatcaaaagcatataaataaacataatgtgattcatcttgatatccaaaagtttttaagtgttaatgattctattcaggaaatgatcaaagatataaacgaatcaattttatttgaactaattgaagaatatggagatattaaatttataagaaaagatatcttatcaagggtattatcacaaatatttgcttacactaatgaaagttttatttttatcattgatgaatgggactgtatttttagagaatataaagaggataaagaagctcaggaaaaatatctggattatttaagactgttattcaaagaacagccatatgtcgaactggtctatatgacgggaatcctgccaatcaagaaatatggaactcatagtgctttgaatatgtttgatgaaatctcgatggttgatcctggactgttacctgaattcatgggttttacagaaaaagaagtggaaaatttatgtataaaatatgatgttagttttgaaatgatgaaacagtggtatgatggttatcaattgaccaaagaaatatctgtgttttcaccaagatcagtagttgcttcaattattagaaagaagtttgataactactggacaagtaccgaaacatatgaagccttgcaggtatatatcgatatgaattatgatggcttgaaagatgaagtagtaaaacttttagcaggagaggatgtaaggatcaatactgataaatttcaaaatgatatgacgacgttcaaatcaaaagatgatgttttgacattactgatccatttaggatatctaggatataatagagagaatcaaaaatgttatattcccaataaagaagtaacgagtgcttttattaattcaatcgaagattccaactggaaagaaacgacaagagccttattgaacagtcaggaattattagaagcaacatggcaaaaagatgaagaagcggtagccaagtatctagaagaagcccatttagatacagcgatattaacatataataatgaaaatgcgctgtcatatacgatatcgatagcatatatggcagcaaggaatcattatacaataataagagaaatgcctggaggaaaagggtatgcggatatggtctttatccccaaagaggataaaccggcgttgatcgttgaattaaaatgggatcaagaggtagagacagcaatagatcaaatcaaagagaagaaatattattttggattagaaaagtatttagataatttactgttgattggaatcagttataataaagagacaaagaagcacagttgtaaaattgaaaaatatagacagtaataaaaggaggtgacaggatgggaatatatttaaatccagggaagatgtcatttttacaggcgacaaagaatccaatatatgtagataaatcattattgatagaatatactaatagtttgatgggaatcaatgattgtaagatctgtgtttcaagaccaagaaggtttggaaagagtaccgatgctaatatgttagtggcttattattctaagggctgtgattcattggatatattcaacgatttaaaaataagtcaaacagaattatatcaaaagcatataaataaacataatgtgattcatatcgacgttcaaaagtttttaagcaacagcgaagatattgataagatgataaaacttttaacgcaaagaataatcaatgagataaaaaaagaatatgatgttgagttgtttgatgagacaagtttatcaatgtcatttgaagatatatttgcaaaaacaggagaacaatttgtttttatcatcgatgaatgggactgtatttttagagaatataaagaggataaagaagctcaggaaaaatatctggattatttaagactgttattcaaagaacagccatatgtcgaactggtctatatgacgggaatcttgccaatcaagaaatatggaacccatagtgccttgaatatgtttgatgaaatctcgatggttgatcctggactgttacctgaattcatgggccttacagaaaaagaagtggaaaatttatgtataaaatatgatgttagttttgaaatgatgaaacagtggtatgatggttatcgattaaccaaagaaatatctgtgttttcaccaagatcagtagttgcttcaattactagaaagaagtttgataactactggacaaataccgaaacatatgaagcattaagagtctatatcgatatgaattatgatggcttgaaagatgaagtagtaaaacttttagctggagaggatgtaaggatcaatactgataaatttcaaaatgatatgacgacgttcaaatcaaaagatgatgtcttgacactgctgatacatctaggttatctaggatataatagagagaatcaaaaatgttatattcccaataaagaagtaacgagtgcttttattaattcaatcgaagattccaactggaaagagacgacaagagccttattgaacagtcaggaattattagaagcaacatggcaaaaagatgaagaagcggtagccaagtatctagaagaagcccatttagatacagcgatattaacatataataatgaaaatgcgctgtcatatacgatatcgatagcatatatggcagcaaggaatcattatacgataataagagaaatgcctggaggaaaagggtatgcggatatggtttttatccccaaagatgataaaccggcattgatcgttgaattgaaatgggatcaggaggtagagacagcaatagatcaaatcaaagagaagaaatattattttggattagaaaagtatttagataatttactgttgattgggatcagttataataaagagacaaagaagcacagttgtaaaattgaaaaatatagacagtaataaaaggaggtgacaggatgggaatatatttaaatccagctaataatggatattcagaaacaaaaaacggtaaagtctttgttgataagtctttgttgatagattacacgaatcaggttataaaaacaccacaaaaaaatatctgtgtctcaagaccaagaaggtttggaaaaagcacggatgctaatatgttagtggcttattattccaaaggttgtgattcatcggatatattcaatgatttaaaaataagtcaaacagaattatatcaaaagcatttgaataaacataatgtgattcatctcgatattcaaaagtttttaagtgttaatgattctattcaggaaatgatcaaagatataaacgaatcaattttatttgaactaattgaagaatatggagatattaaatttataagaaaagatgtcttatcaagggtattatcacaaatatttgcttacactaatgaaagttttatttttatcattgatgaatgggactgtatctttagagaatataaagaggataaagaagcccaggaaaaatatctggattatttaagactgttattcaaagaacagccatatgtcgaactggtatatatgacgggaatcctgccaatcaagaaatatggaacccatagcgccttaaatatgtttaaagaaatttcgatggtcaacccaaccccactggaagaattcatgggctttacagaaaaagaagtggaaaatctatgctgccagtataaaatggaatatgaaaaaatgaaagaatggtatgatggttatcgaatgagtccaaggatatcgatatataatcatcgatcagtagtatatgcaatcatggacaaaaaatatgaaaattactggacaagtaccgaaacatacgaagccttgcaggtatatatcgatatgaattatgatggcttgaaagatgaagtagtaaaacttttagctggcgaggatgtaaggatcaatactgataaatttcaaaatgatatgacgacgttcagatcaaaagatgatgttttaacattactgatccatttaggatatctaggatataatagagagaatcaaaaatgttatattcccaataaagaagtaacgagtgcttttattaattcaattgaggattccaactggaaagaaacgacaagagccttattgaacagtcaggaattattagaagcaacatggcaaaaagatgaagaagcggtagccaagtatctagaagaagcccatttagatacagcgatattaacatataataatgaaaatgcgctgtcatatacgatatcgatagcatatatggcagcaaggaatcattatacgataataagagaaatgcctggaggaaaagggtatgcggatatggtctttatccccaaagaggataaaccggcgttgatcgttgaattaaaatgggatcaggaggtagagacagcaatagatcaaatcaaagagaagaaatattattttggattagaaaagtatttagataatttactgttgattggtattacttatgataaaaatagtaaaaaacatatatgtaagatagaaaaatatgtgtgttgatctttcatgtattttatagagttaaaattttatatataaaatcaactaaaaataaaagataataaatttattattggacagctttattttggttggttttttttatattcagtgatataattgttgagaaacttttgatacaaatttgagacgaaaaagtgattaatctgtagtataataataatgtaaaggagtctaccatgtatagttatttaattgggactgttgtagaaataaatatagatcatcttgttgtagagaataatgggattggttatttgatttatgtaagtaatccttatgagtttactaaaggtaaagaagttaaaatatatttataccagcatgttaaagaagatgatttgcttttatttggttttaaaactagtgaagaaaaagaaatgtttttaaaattgattcttgttaaaggaattggttgtaaaacggcaattgggattctagctactggtgatgttacaagtattattagtgcaattgaaactggtaatgttgcttatttaaagaagataccagggatcggaccaaaagcagcgcaacagattattttagatttgcaaggtaaatttaaaaatacgacgacaacaattattaataataatgatttagatgaagctgctgaagtattagtagcgttaggttataaaaaagctgaagttgataaagctttagctgtattattaaatgaaaaattagacacgaatggatatgtaaaaagagcacttagcttattggtaaaataaggaggagcatatggcaagaaatgagattcttgatgtcaatatatgtgaggatgaagaaagtagtcttagaccttcgtcttttgatgaatatgttggacaaacaaatctaaaagaaaatttaaaagtatttgtaggtgccgctaaattgcgtgatgagtcccttgatcatgtattattatatggaccaccaggtttagggaaaacgacaatgtcgatgatcattgccaatgaaatgggaacaaacattaaaattacgacgggaccgagtattgaaaaaactggtgatctagtagctattttaacagcacttgagccgggtgatgttttatttatcgatgaaattcatcgtttgaataaagtggttgaagagattctctatcccgccatggaagatttttgtgtcgatgttgtaattggtaaggaagcttcaacaagatcagtacgaattgatttaccaccttttacattagtaggggcaacaactagagctggtgatttatctgctccgttaagagaccgctttggaattgtctctaaattagaatattatgatgaagctgatttaaaaacgattattgatcgaactagtcgggtttatcaaatgccaatggatgatgatgctaaagccgctttagcgatgcgttctaggggaacgccgcgaattgcaaatagattatttagacgagtacgagattttgctcaatttaatggtgaaaatgtgattactaaagaaagaacgattgaagctcttgatcgtttaaaggttgatcagttaggtttagatgatgttgatcataaatatttattaggaattattcatcgttttaaaggtggaccagttggtttagaatcgttggcagcttcaattggtgaagaaccgcaaacgcttgaagatgtatatgaaccatatttattacaaattggtttaattaaaagaacgccaagagggagagttgctactcatgaagcatataaacatttaaatattgaaaaagaagactaattaactagtcttttttatgtaaaatcatgaagaatttgacttgacatttattttagggacgatattataaattatagtaatgtggggatggcaaaaaaatgaatagaaaaataatattatgtttactttgtataatggttttatgtatcgcttttttaaaaaagtcggaactagcagcttttacgcttgaaaacgattctgatgtgatgagtctagatgaagcagcaaaattaatcaatgaacgtgtaaattcaaaaacagataagtcaaaagcagtaaatgaaccgtatgtatatcctataattcctggaaccccagaatggaagcaattggattcaaaggataaaatgatgatggcttgtcagattccttcttcactggttgactcaatgtcgacggaagctttgatacgttcatttataaatcatcctttattgagtacaaatgttatttcttatgatgattataaacaggggtttgatacttttatagctgattttgatgctgctaaagaattgttaaaaagaaaagattttgcaattaatttagcgaaaatttatttagatacaccagttttgagtgtagaagagtatcaagaacagtctgttgaatctaatattatgattgattttatcgtattagaaactgttttagctcttcctcaggtatttgatttgtttgaagaagatgaagcgcaggcattgatgataattgctgatagtaaattggaagaaaaacaaaaaaatgagaaaatatatggtggatcatatgatagattttttatagtaagacaagcagttgttaaggaatctagaaattggccaataatttttatgtattcaggggcttttttattattgattttgttttttattaaatgtttattgtttaaaaagataaaggaatagttttgttatagtatatataagataaagaatcagtgttgtgctgattctttttgatttggaggaatgaaatgaaaaagcatgaacttattattttattactattgttaatcatttctacagtttattcatttgctttaccagaaaccgaagttaaacaaattaaaagtgatcctaaaattaaaatagtgattgaaggaaagtataatcaaacgcttacttttgatcaagcaccgactattgaagctgtttttaaacagcttaatgtagaaaatatttatggctttgatgaaaaaactgtacttatgacaaggacagttttttatatccctgagggaacaaatttaatttctttaaataatgcaactaaagaacaattaatgacaattaaaggaattggagataaaacggctgataaaataattgcgtatcgccaaaaaacgccattttgtacaattgaagatattactaatatatcaggaattggtgaaaagacgtatttaagaattaggagtttattatgtttataagatatcatcttgttttttatggaatcagctgtttattattgattgtatgtttattagtacatccaatattttgggtgttgatgatagggtatgggatttttgttatatatcgtttgaaaatgattaattttattagtatttttatttttacgattattttttctttttttattaattggcctaagccaattaatgatacagttataaaaggtaaaatagttgatcttgatgaaaaaagtgtcgttgttaagactgatgaaacaaaagtaaaagtatatgggaattttattggttatcatcttgatgatgaattagagatggaggttgagtattttgagataaatgagccgactaacgataatgcttttaattataaaaattatttatatagtcaaggcattactaataatgcttcgattaaacgtttattagatgtaaacactaaagaaacattattccaaaaattgcaggagagaatatctagtaatgatcttattgacagctatgcttcgatgtttgttttaggcataaaagatgaggttattgaagattattatcaacagttaacggatttatcagtagttcatttatttgctttatcaggtttgcatattcatttgttaaaagatatgttaaagaaggtattgcggttttttatgccggataaatatattgattattttggaattgtcttgattggaatatatatttatcttattccttttaatatttcttttgtgcgagcttatttggtcatggtattagcggttttgtttaaaagatatttaaataaattagattgtttatcaattgtaacgattataatgttatggactaatccgtatattatttttagtttatcttttattttttcttatttcatttattttgttattttattgatcaataaaaataaatattttaatttgttagtgtattttggcagtttaccaattattttaatgattcagtatcgaatcaatatattatcattgctgctaggaattgtattagtacctttagtgagcttattgtatcaaatgatttggttatatatgatctttggagatgttgttaggggcttggtaatggtaattatttattttttgaataatattattactttttgtaatgatttttcagtatttcttaatttttcgaaaccgtcattgttttttattttagtttattattttatttattttaaaataattttaaaaattaatattaaacgaaatgtaactagagaggtcttgctgctgtttagtttattactgatgttttatttaaaaccatattattgtattgaaggaaaggtcgtaatgatcgatgttggtcagggtgattgctttttgattcaacagccatttaatcagggaaatattttaattgatacagggggattaaaaaataaagatctagcttcacttacattagtgccatatttaaggtcacagggaatttttgaattggactatgtctttatatctcatgatgattttgatcattgtggggcctatgagtcattatctaatcaaatagaaataaagcacactgtaaaaaaatatcaagagaaaatgaaaataggaaatattgaaattgaaatgcttaaaagtgatgttagcagtaatgaaaataatgatacatcattagtcattaaagcgacaatcaatgatcttgtttacttatttactggtgatgcttctaatttagttgaaaaggatctgataaaaaaatatcctgatttaaaagtagatgttttaaaggtctcccatcatggtagtactacggggacatgtagtgagtttctagaagttgttagaccaaagattgcgttgatcagttgtggaagagataatcgttatggtcatcctagtgatgctgttttaaggagattagaagactatgatattaagatttatcgcagtgatttaatgggaatggtgaaaatcgtgtattatggcgatgataattatatttatccatgactttatgataaaagtagtttataatacagatggagtgatacgtgatgatatttgtaatttatggtgaagaaagttttttaatggaacaaaaacttcaggcattaaaaaaagaatataattgtagtgaagaaatgatgaatctttctacttatcgtggtgatgaagacagtattgagtcagtatatgaagatttgattacaccgcctttttttacggataaaaagatgatcgtgttgaaaaatctgtactttttaactactaaaaagctaaaaaaagataacagtgagatcgaatattttgaaaagtgtttagataatgatagtaaagaggtaatttttgttatttatcatgtagggaaagattttgatgaacgtaaaaaaatcgttaaaagattacgtaaagaagcaaagttttttgaaatcgataaagtcaatcattataaattatcagatagtacacgtcaggctgtaaagcgtagaaatgctattatcgatgatgatgcattagagttattattaagtcgtttaggtgatagtttaaataatgtcgttatggaagtagagaaactatgtttgtatgataaacatatcacttatgaggcagttgataaattagtaagcaaaccactggatgaaaatgtttttgctttgactagtgcaattcttcaaagagatcgccaaaaaatgttttctatttataaagatctaatgattttaaatgaagaaccaattaaactaattgttttgattgcagggcagatgcgacttatttatcaagtgaaattattagatcgaaaagggtatactgataaagaaattggaaaaattttaggtattaatccttatcgtttaaaatatcttagacaagaagggaaagactttgatttaaatgaattgttgaagtgtttagatgctttatctaaattggatgttgagataaagacaggtaagatcgataaaaaaatgggattagaattatttatgataagaatataggagattatatggaatcgttaagagaattatataaaattggagttgggccttcttcatcacatacgatgggaccgcaaagagctgcctcaaaaatcaaagagacatataaaaatgctgatcgttttatagtatatttacatggttcattagctttgacagggaagggacatttaactgatcatattattgaagaaactttgggaaaagaaaatgttgaggttcattttgttagtgaagctttacctaaacatcctaatgggatggtttttgaaatctaccaaaaagataaactgcttgataaagtaacggtttattcagttggtgggggtgctttaatgtatgaaaatagtgaattacagccgcctaaacaaatctatccccatcataatttaaatgaaatacttgattattgtgataaaaaaggaattaatctttatgactatactttaaagtttgaaaacaatgattttaaagcatatttatatgagattcttaatgctatgtttaaatgtgtagagtcaggtctttcaacaacaggaatcattcctggcagactgcaattaaaaagagtcgctaaatcgatctatcagcaggctatcaatacccgacgaagcggagaacgtgatcgacttttgataagcagttatgcttatgctgtcagtgaagaaaatgcttgtggtcatcaaattgttacagcaccaacctgtggagctagcggagtattaccggcagtgatgtattactgttataaacagttgaatattcctcgcaaagagttgattaaagctttagcagtagctgggatttttggtaatgtgatcaagactaacgcaacgatttctggagcagatggcggttgccaggcggaaattggtagtgcttgtgctatggctgcagcagcttatggctggaccttggaattaaacaataatttaattcagtatgctgcggaaatgggcttagaacataatttaggattgacttgtgatccagtaggtggatatgtccaaattccttgtattgaacgcaacggttttggtgctttaagagcgatcgatgctgcgatgtatgcaaagcaattggggtatttaagaacaaacaaagtttcatttgatgctgtggtaagggtaatgaagcaaacaggtaaagatttaaatagtgcgtataaggaaacgtctttaggtggtttagctaaagaatttggatttgaagatggaaactaattctttatatattcatattcccttttgccaggagatttgtgcttattgtgatttttgtaaagtcttttatcaaaaaaaacaagtagatgattatttagcagttttaaaaaaagagttgacaagtttaaatattacagaaccattaaaaacaatctatctaggtggtggaactcccactagtttaaatgatgaacagctggaatggttgatggatattattaaaccttatataagtgaaaaaactttagaagtaacgatcgaggttaatcctgaaacgcttgattattataaattggatattttaaaaagaggcggagttacacgattaagtattggtgtagaaacttttaatgatcgacttttaaaaggaatcaatcgtaaacataatagtgagcaggtaaaaagaattattcgctatggacatcagttaggctttgataatatttcaattgatttaatgtatggtttacctgatcaaacgatcgaagatgttgaaaatgatttgaaaattattgaatctttaaagattcagcatgtatcgtactattcattgattctagaagatcatactgttttaaaaaatcaaaattatcaaccgttagatgaagaaacagaagctgatattaataaattgatcgatcatcaattaaaaaatatgggctttattaaatatgaaattagtaattacgctaaaccaggttttgaatcattacataatttagcgtattggcaatatgataattattatggtattggtttggggtcaagtggtaaagttgatgattgtttaattgaacatagtcgtaacttaaatgcatatttaagatttcaggatattactaataaaataaccaattctaaagaagagacaatgtttaatcatttgatgatgtcattacggttaataaaaggactcgatctagatgaatttaaaaatcgttatggattgaaggttactgatgtttatcaagaggcaataaataagcatcttgagttaaagacattagtaatagaagatggttatttgcgttgtactaatgattcaataaagttgttgaatactattttgcttgattttattaaatgatgttaattcgtatgaattagcatttttttatgctataagttatcgaaaagaaataatagataattgaatatttatgaaaattataaaaaattggctatatataaaataaaaataagatatttatattatgtacgatttacaaaactagttgtttatctttaccttgaatgaaagcgctataaatgttactttctatcataaaggaggataataaatagaagtattataaaaatcaaatcaaagcggaggaaaagaaaaatgaaaaagaagaaaatattttatggctttttaagtacgatgatgcttttatcagcaacatctttaccagcttttgctaaagaatcaattgctgttagtggggttcaaaaagcttatgttgtacccgaagattggggaccggttgtaaaaaaatcagttattaatttaaatgaaaaagtagctagcaattcaattggtgatgaaagtgatgaatttactgtgatagaaaccaagccaacgcttaccccttcatggacggttgttactagcagtagtcaaaggacagttttagatgcttatacatcagatgaaataggaaataagatatctgaagattcaaattatattacgattgaaatgtatgtaagtccaacttcagatggtgaaggagcagcttttatttatagtgggtataataattggtgtgatccttatcaattggatattcaattgaatggtgcattacaaacagctgatggacaaattattaatgaattaactattgataaaaatattgatttggaaggtgatggaaaaatttgtccagaagtagatgagtttgaaaatggagtatttaatgcttccgatggtagagtgctaccttatgcagtatataaaccagctgaagataacaagaaaaatgctttagttatctggttgcatggttcaggagaagggggaacaaatcctgaaattgcttatttaggaaataaagttacttctcttatcagtgatgaatttcaaagtagctttggcggtgcctatgtgctggttccacaatgtccagaaggatatggttggccaattgatgaaaatggtaattatacaaccggagcaacaccttcaagatggcgtgtgagtttgtttgagttaattgatacatatgtaaatgaacatccagatattgattctgatcgtattattattggtgggtgctcaaatggtggtaatatggtttatgatctagtattaagtcatataggttatttcgcggcagcatttcctatgtgtcatgaatataacattaataatgtaacagaagagcagcttgaatatttaaaggattttccagtatggtctacatatactttaggagatagttctagttatcgtggatcaattccgatagtaagaaaaatgcaagaaattggtgctacagcttttcattattcagaatttaccaatgcaagtgatgtaactggaagattttttggagatccaagtgatcctacagttttagatacgacgggaactagtacgattcctttacaatatgatggacactgggcatggactttattttttgaaaatcaatgtcgtgatggtgatttgacagcatggcagtggttagcacaacaatcaaaaataaatgatcctgcagataaaaccgcattacaaattgctgtagaaatagcaaataatgtaagtgaagaagaattaacaaaagtagtaccggcagtagcaaatgaatttaatgttgcgctagaagaagcaaaggcattattagcagatgctacagctagtcaagaagcagtagatgcagcatttaaccgtctagcaaatgcgattcaaatgttggattttattaaaggagataaaacagatttacgcaaacttgtagaattagttggaaaaaatgtaaaagatgaaacattatatataagtgcaacatggagtgtatttgcatcagctttggaaacagccaacagtgttttagttaatgaaaatgtcatgcaggatgaagtaaatgatgcatatgatggtttggcaaaagcatactttgggttaagattagtaccaaataaagatatgttgaatgaattgatcaataaagcaaacggattaaacgcagcaaactacagtgcaagtacatggtcagtattgagcgaagcattagaaaaagctaatatggcaatagcaaatgaatatgccagccaagaagaagtagatgctgcatatgaaacattaaatagtgcaatcgtaggattaacaactgattcagaaatgacaaatagtactgtagatgaaagtataacaaatggtatagtaaaggcaggagatacaacagcaggtatcaagacaggagattcagtagacttagaatattcattagtaagcttagcactagcttcaatcttattagttataaataaaaaaagaaaatatcaaaataattaaactaatatataataacagcacagcttgtgctgttttttgtaaattaaataatttaaaaacttcttcattttttagcacaaaggtgttgacagtgctaaaaaaagatgtataatgtatttagcacaaaggaagaaagagtgctaagggtggtgaaaagatgcttacagcaaggcaattattaatctttaaatgcatagttgatgagttcattgaaacggctgaaccggttgggtcaaaagctttgatgacaaaatatcagttgccttattcaagtgcaaccatccgtaatgagatgagttttcttgaagactatggttatttagaaaagacccatacttcttctggaagaattccttcgattgaaggatatcgattctatgttaataatcttgctaaaagagatttagatgaggaattgaaaaatcaagtggcgcaaatatttagtgatcgtcatcgtaccctagatgagataattcatgaaagctgtcagatattgagcgaattaacacatttgacatcagtagttttaggacctgattcaagtgctgatactttgcagcagatcaatatcgtaccgttaaatgataaacgagttacagctattattattactaatcagggtcatgttgaaaataaaatctttgatttaaatcgtcatcataatattgatgatttagtaagctgtgtcaatgttatgaatgatctattagttggaacaccgatcgatcaggtggtatttagacttgaacgtgatgttaaaccagtcttatcagcaaaggttaaagaacatgaagaattatttaatgcttttctagaagcatttgtaagatttgcttctagcaatgtttatttttctggaaaagagaatatgttatatcaaccagaatataatgatgtaaataaattaagaagaatcgttagtgcatttgaaaactctcaagtatggaatgccttacagcctttatctgacgatgagggagtaacggtaagaattggaactgattcgccaatcaatgatattgatgatgtttcagtaatatccgcttcgtttaaaaccggagcgacaaccaaaggatctatttcagttatagggccaactagaatgccttatgaaaaagtagtttcgttagtagagtatatttcaaagaatattgaacaagcattctttgatgaatcagatgattcaaacgatgaatagaggtgaaggtaatggctgaagaaaaaatggtggatcaagagtctgttgatgaagaaactgttgaagaaacagttgaaaatgatgaagaaaaagaagaagttactgttgaagaacagctgaaagctttggaagaagaggtaaatacttggaaaactgattattataaagtatttgcggatatggaaaatcttaaaaagagattacaaaatgaacatgcaaatacaatgaaatttatgatgcagtctttcattgaacaattattgccagtggttgataattttgaaagatcgttagcagttgaaaatcctagtgatgaaatcaagaatttcttaaaaggatatgaaatgatttataatcagttgatgcaggttttacaatcacagggggttgaagtgattaaaaccgaaggagaagaattcgatccaaacttccatcaggcagtaatgactgtaaaagatgataactttaaatcaaatatgatcgttgaagagttacaaaaaggatatatgttgaaagatcgcgttattcgtgcatctttagtaaaagtaagtgaataaataggaggaatttattatgagtaagattattggtattgatttaggtacaacaaattcatgtgtcagtgttatggaaaacggtgaagttaaagtcatcgctaatcctgaaggtaacagaacaacaccttcagtagtatcatttaaaaatggtgaaattatcgttggtgaagctgctaaacgtcaagcagtaacaaatcccgatacagtaatgtcagtaaaacgtcatatgggtacaagccataaagaacatgttaatggaaaagattatacaccacaggaaatttcagcaatgattcttcaaaatttaaaagccactgctgaagcatatttaggagaaccagttactaaagctgttattacagttcctgcatatttcaatgatgcacaacgtcaagcaacaaaagatgctggtaaaatcgctggattagaagtagaacgtattatcaacgaacctactgctgcggctttagcatttggtcttgataaattagatcaagaacaaaaagtattagtatatgacttaggtggaggtacatttgacgtatctatcctagatttagctgatggtacttttgaagtattagctacagctggtgataacaaacttggtggagatgatttcgaccaaaaagttatgaactggatcgtagatgaatttaagaaagaacaaggtattgatttatcaaatgataagatggcaatgcaacgtattaaagaagcagctgaaaaagctaaaaaagatttatctggaacaatgcaaacacaaatttcattaccatttatctcagctggtgctgctggacctttacacttagagttaacattaacaagagctaaatttgatgaattaactcgtgatttagttgctaaaactgaaattccagtacgtcaagcattaaaagatgctggtatggatccaactgagattcatcaagtattattagttggtggttctactcgtattcctgcagttcaagaatcagttaaaagattattaggaaaagaaccaaataaatcagttaaccctgatgaagtagtatcaatgggagctgctatccaaggtggtgttattcaaggtgatgttaaagatgtattattattagatgttacacctttatcattaggtatcgaaacaatgggtggtgtaatgactgtattgattgaaagaaatacaactattccaactactaaatcacaaattttctcaacagctgctgataatcaacctgctgtagatatcaatgttttacaaggtgaaagatcaatggctaaagataataaacaattaggtttatttaaattagatggaatcgaaccagcacctcgaggagtacctcaaattgaagtaacattcagtattgatgttaatggtattgtaaatgttaaagctaaagatttaaaaacacaaaaagaacaatctattgtaattcaaaattcaactggattaagtgatgaagaaatcgatagaatggttaaagaagccgaagctaataaagctgaagatgaaaagaaacgtaaagatatcgaaacaagaaataaagctgaacaaatgatcaatgaaattgataaagctttagcagaacaaggtgataagatcgatgctactcaaaaagaatctgctcaaaaattaaaagatgaattaaaaactgctttagataacaatgatatggcaacattagaagctaaaatgtctgaattagaacaaatggctcaacaaatggcttcatatgcttatcaacaacaaaatggtgctagtggagctaatacaagttcgacaaattcacaagatgataatgttgttgatgctgattttgaagaaaagaactaatttattaaagccaaggctttgccttggttttaaataatgtaaagagggtggaaagatggctgataaaagagattattatgaagtcttaggggtatcaaaacaggcttcagccgatgagattaaaagagcttatcgtaaaaaagcaaaacaatatcatcctgatatcaataaagagccaggagcagaagaaaaatttaaagaagtccaagaagcttatgaagttttatccgatgctaataaaaaagccacatatgatcgctttggtcatgctgcttttgaacaaggagctggaaatggcggaggcggtttcggtggctttggcttcgaagatgttgatttaggagatatatttggttctttctttgggggaggtagaagtcgccaaagaaataatggaccaagacgtggtgaagatcgtttaatgcgcttgaatatcgattttatggaagcagtaaatggtgtaaaaaaagatattaaagttacttacgatgctgcatgtggtcattgtaatggaacaggagctaaaaatcctaatgatgttcaaacctgttcacgatgcggtggacgaggaacgatccaacagcagcaaaattcaccatttgggacttttgtcacagaaacaacgtgtcctgattgtaacggaagcggtaaagtagttcgtaataaatgtccacattgtcatggtagaggatatgaaaccaaaacagttacagttgaattagatataccagctggtatcaattctaatcaacagttacgagtagctgggaaaggtggccgtggcagcaatggtggaccaaacggtgatttatttgtagaaatccaagtaagaccacatgaacatttccaaagagaaggacggaatatccacattacgattccggtatctaatgtcgatgctactttagggtgtgaagttgaagttccaactgttcagggtgatgttacagttaagattcctgcaggaactcaatcaggaacagtattacgtttaaaaggtaaaggtgttaaagatttaagaggttcaacttatggtgatgaaatggttagaatagaagttaagattccaactaaattatcatttgaagagcgtgaattatatacgaaactttctaaattatcgagaaaaaaagaatctatttttgatgcttttaaacgtcaatttaaaaaataggatatgagtcgagactttgtctaaagtttcgactctttttttatccttttaatcataaattaatgtataattattattgaagggatgtagggatatgaaaaaaattatatatatattattaattagtttatttattacaggatgcggtgaaaaaactaaaataaaaacagaaaaatcactttattttgtatttgcaacgccgttgaaagaacatgaaatctggttaaaagcaaaagagggtttcgataaagcctgcagtgagaaaaaaattcatggtgattggctgggtccaacagcgattgatacagctaagatggaagaagtgatcgaaacagcaattgctcaaaaagccgatgcaataattactcagggggtaattaataaggatattatagatagagctaaagaaaaaggaattcctattttattggttgattcagatattaaagattgtgaacgttttgcgtatttgggaaagaattttaatgaacaggcagaactttttttatctgatatagaaaaaaaattaggcaaagatgtctttttggaaattggaatacaagtggcagaaaaagattttgacatagctagtgaacaaattaaagaagtagaaaatgtttttgcgaaacatgaagggggttttgtgattaaaactgttagtgaatcaaaatcggattcagtacgagctaaaaaggaatggttgaatactttatcttcaacaacgatcaatgtcgctattaattttgctggtgaatcagctatttcttgtaacgaagcggctaaagagttagaaattcgagatgcgatgcttatctatggtgtggatgatatgccagaaacaattaaattaattaaagataaacaaatagatggcagtgtagctacatcattttataattatggttatgaaggagtaaattggttatatgattatttggttaatggaaaagagttaacccaaaaagttaatagtgtgaaattagtgctggtaactaaagaaaatgtagatgattatcaagaggaattaaaatgaaggataaatcaaagataagttttaaacatagcattataaaactgaattttagtttggtttgtataatgacagtttttatggtgataaattatattttatcgcaaaatacaacaataaaatataataatgcaatttctttatatgatgatataaatgagttttatgattatgtagcacaggctaattttagttttaaaagttatttatatacggaaaatttagaagatattgatacatataatcgttgtatttcgatagctcaggataaattgaaaaatgttaaagataatattgatgatgaatatcgctggcgctttgatttgcttagtaatatgcttgaaagttatcaggatgctgcaaaggaagctaaagatgttggtggattagattatcaggtaaaatataatgaactactgaatcaattttctttgattgaaaaaacaagtacaacttattatgagtatttaactgacggaatcaagagtcaaagagaagaaattcataattatgaaaatctgctttttattgtaattgcaattattatggtagcagggataatttggcttattttgttttcggttattacagtacgttcttttacacagcctttatatcaaatattgaataatattaaattaataaaaaggggtgagtatgatctttcaagtatttctaatacttcgatggaaatggaaggattgtgctttgctttagaggatatggcacagcatgtgcaaagaaatattcaaaacgaaaaagaaaaagctgcattaaagcatcaattattagaaaaggaaaatgagaatttaaaaaaagatgaattattagctttaagtgaattaaaattgcttcaaaatcaaattaatccccactttttatttaacactttaaatatgatttataaaactgcttataaagaaaaagcgatggatacaagtgcgatggtcaataaaacatcaatgttactacgatatgctttagataaagcaaatagaacaagtgatttatatagtgagattgaatcaattgaaaattatatttatattcaagaaagaagatttcatcaaagaatcaagtttgttttgaacgttgaagataatttgcctaatattcaagttcctggtatgttgattcagccattagtagaaaattcagtaaagcatgggttaaaggatgtaattaaagatggggaagttttaattaatgttcagcacattgatgatcatatagttattagtgttagtgacaatgggatagggttagaaacagaaattttagaaaaaggaattttaaatgattttcatgacaaaaataaaaacaaccttggtttgtataatgtgatccagcgcattaaaatgttttatggaaatacagcacaaatatcatttaatagttatcctggttgtggttttgaagtaattattgaaattaaagtggaggaaatttatgtatcggatattagttgtcgaagatgaagaaatagagcgtaaagcgtttgtatcactattaaaagaacatttttcacaatctttgattgtatataacgcctctaatggaatggaagctttggaaatattaaaagatgtagatattgatatcatagttagcgatattaatttgcctggaatcaatggtttagaaacgattggatttgctaaaaaaataaataaggatatcgtgagcttagtgatcacctcctataattattttgaatatgctcaagaagcaatcaagctggatgtagaggattttattttaaaacctgtatcgattgaaaatatgtgtaatattatttatcagataattaataagatcgataagaagaaaaacgagaaaaatcaagctacgcaattagtcttaaagatggaggaacttagaccaatcattgaaagtgattgtattcatagtattgttcaaaattctaaacctgatgaaataagaaaatatttttcgcttttaaatattgttcctaaatcaggattttgtatagtttttcaaaaaaatagttttcagccttatcaaattcattcatttattgctgagatagaagatcttggctgccgctgtatgaaagatagttattatgaagtgcatgttttatttgtttttagtcttgcgagattatcaaatcaggatattcaaatatttgaggctttaataaagaagtatttttatggtttggatcaaatgggggttggagatatttgtgttaattatgaaaatttttatgaatcttatgtgtcggcaataaaaaatattggttctataattgagttaaaagaaagtgattctaaaaatagtttatcgacagggtattcatatgatgtagaaaaattatgtcaaaatttaataaaagattttttaaagtttgatacattaaatatgcaacgaagaattaatttgttttatttggaaattatatatatagacaaagtttcgttattaaaaattattcaagattttaataagacattaattactttatttaaccaggaattcaaatctaaaattgatttttatgatcaggaatatgtaatagaattggatagtgataatcctcatcgtgatctactggagaagataaatgtttttttagataatttagttaaatctattaataaatgtgataaaaaatcatctaatgttttagtaaagaaggctttggcttatatatcgcttaattataaaaagaacattactttaaataatgttgcatcatatttaggcgtgacaccattttatatcagtaatctactaagtactcatacatctaaaaatttcacagatttagttactgaatatcgaattgaaaaagctaaagaaatgttgaagggaaactatcaaattaaagaaatagcagttgaattggggtttagaagtcataattatttttctaaagtgtttaaaaaggttacagggttaacaccaaaagaatataaatcgaagtttgattagttatatagtaaaaaaagtgtttaaaattatagtttttatttgatgattggaataaatgaaaacttatgttttaacactttttgttattaatttgtatcatagaataattataattggataaaataaaaatagtactgatagtagtactatttatattattaagctgattttctcaaagttcttaattctctagcagaaattcttactgttgtaggtttaccatctactaaaatagtagctttttgtaaattaacattccattttcttctacttgagtttaatgcgtgagaacgtgtatttccagacataggtcctctaccacttatttgacattttcttgacatggttctcctcctcttcattagtagtgttttaacgtacttggatattctatcattatttgatgagaaaatcaattatttttaaaaaaaaatcaatatttttttcttgcaataaaaatgagttctgttaaaataaattctagtgttagtaattgtcaagaactgctttttaagatataattagttattgatgagtatcgacaagatagatacaaggaggtatataaatgattgaaaaaaataataatatgggaactgtcaatatatcactggatgttgttgctacaatcgctggtggggcagcaatcgaatgttacggggttgtagggatggccagtaagaaaaagttaaaagatggctattatgatcttttgcgtaaagaaaattattctaaaggtatagtcgctcgtgatggtgagacaggacttattttagatctttatgtattgttaggatatggaatcaagatgaccgaagttttgcatgaagtgcaaaagaaagtaaaatatgttgttgaatctactttagatgttaatgttgaagctgttaatgtatatgttcaaggtgtacgtggaatagagtagaggagatagaaaatgaaaatattatctggtaaattatttaaagagatggtgttgtgtggagctaatactttgcataataatcatcctgaaattgatgcgttaaatgtctttccggtacctgatggtgatactggaacaaatatgtctttgacatttttagcaggtgctaaagaaattgaaaatctagattctaacaatattggagaaatatctaaaaagttatctaaagggctactaatgggagctagaggtaattcaggagttatcttgtcacaaatctttagaggagttgcaatggctttacaagggcatgaagaagcagatgcagttctttgggcacaggccttggaaaatggagctaaagttgcttataaggcagttatgcgtccagttgaagggactattttaacagtgattcgtgaagcgggtgatgccgttgttaaatatgcaaaagaaggaatggaaattgaggacgttttttcttattttgtaaaagaagcagaaatctcacttgaaaaaacaccagaattgttgccggtgttgaaggaagttggagtagtagatagcggtggagctggtttattattggtatttactggttttatggcagctcttgctggtgaaagggttgattatgtagaaatcaaatcatcttcttcagcaatggatgctgttgctgaagttgaaggtggagaagaaggatatggatattgtacagaatttattcttcgtttagaaccttcattagttaataagtttaaagaagatcaattaaaaaaagagttagctagaattcctggggaaagtattgtagttgtgcaggatgaggacatagttaaggtccatgtacacactttaaagccaggaaacgctttaaatattgctcaaagatttggtgaatttgtaaagctaaagatagaaaatatgcaggaacaagctgatacgattcaaaataatacaaagtcaatcgtgggtgttgatgataatactaagccagttcaagaagctaaggaaactgcaatcatatctgtatgtgcaggtgatggattgaaggatgcatttttagaattgcactgtgattatgttgttagcggtggtcaaacgatgaatccatcggcagaagatatggttcaggcgatcaaaaatttaaatgctaaaaatgtaatcatcctaccaaataattctaatattgttatgacagcgcaacagactgctacaattcttgaagatgaagtaaatgtaattgttatcccaactaaaacgataccacagggattatcagcatgtataatgtttaatccagatgctgctttagatgataacgttgctgaaatgaatgaagcaatcaaaaatgtaaaaactggacaagttacatttgcaatcaaagatactgtaattgatggtgttgaaattaaagctaatgattatatggctttggttgaaaaggatattgtagcttgcaaagataataaattgaaagctttaaaagttgtactagaaagtttgattgatgatgattcagaattagttactttaatatatggtgaagatgttaatgatgaagatatcgaagaaatcgaaagttttatagaggataattttgaagtggaattagaagtgataaatggaaaacaaccggtttattcatttattattggggttgaataaatcacaaaacgaagataaagagatattcttgattcttcgttttttgtctgtaaaaatatatttgaagatttttttgatttgttaaaaatttttgcgttattataggggttatgatattagaagagctcatattattgaaaattagagctgcttgaaatatgatgaaattgactttcattttttttcataatattatatgctatatttataagagtttatagaagtgaggaagtgaagatatgaagttgacgatttctcaaatcgcaaaaatggcaaatgtttctagaggaactgtagatcgagttatacataatagaggatctgtttctaaagaaacgaaaaagaaaatagaagatattattgaaaaatatgactatcagccaaatgctcttggaagagctctttctcaaaaaaagccttataaaataggtgtgatattgatacaaaaatataatcctttctttgatattattaaaaaaggtgtagaagatgctattgctcaatatcaagattattcaatcgaattaatgataagacatttggaaggccttgatgagaatgaatacattgatgctttgaatgagcttgaagaaaaagttgatgcttttgcagtcattggtcataatacccaaaatattattaataaagttaatgaaattattatgaatggaacaccttttttaacaatgaatattgatttgtttgattcatcgagatatgggtatgttggtattgataattttcagggtggtcaatgtatggcgggacttgttagagatataagacatgatcagacacatattttattgataggtggccatgaagaaaatagattagaaaacgaaagaatcaaaggttttttagaaatagttaatgaagatgagttgattgattatacaaaagttctttacactcaagatgagccggatagagtttatgatatggtcaaacatgaattaatgacatattcatatgagatggttgtgacgattggatatggaacacatattatttgtcaagttttagatgatttagatctgcccaaaagaccattagtatttggatttgatttgttgccagaaaatgaagaatatattaaagcaggtaagatttcatacattgtagatcaaagtgcatatttacaagggaaacaaacgatatcttatatatgtgaatattttatacatagtacatctttacctaaggggaatgtgtatttaccaatatctatttataataaatataatatttagagcagaaaagctctttttttattgagattaaaaaaaataagagtataatatattttaaggagtgcacgtgcacgtgcacgttaaattatgcacaagtatatattaaagaggaaagattatgaaagcgattgtttttgaagatattggaaaatttgctgtcaaagatgttttgatgccaaaagtgaaaaaagcaactgatttattagtgagggttgatgcatgttctatttgtggaacggatgtgcacattttatcaacaccaccgggagtgaatgctaaaaagggaatcgttcttggacatgaaatggttggtacgattgaagaagtcggaaatgacgtgaaaggttataaaccaggtgatcgtattgtgattgacaataatattccatgtggatattgcgaagaatgtcaaacaggtcactataatacatgtttaaacatgaatgctaaaggtgtcgatagtgacggtgtttttgcacagtatgttgttgtacctgatagtgcagcaacaaaagtacctgcaacattacctgatgacttagctgtttttgcagaaccagtaaattgctgtatgggagggattcaaaagttaggaactatgatgccaggacaaactgccgttgttttgggaggaggacctattggactttattatttaaaattattgcaattaaaaggagctggaaaagtttttgtttcagaagtatctgaatatcgttcaaagtatgcaactgatatgaaagcaacaagagttattaacccagccaaagaaaatcttgctcaaattataaaaaaagaaacaaatggttatggtgctgatattgtgatcgatacagttgggacattattgaatgatgctttagcttgtgtaagagcatcaggaacaattttattatttggattaaatggaaatgcaagacaaacaatttgtcaaagtgatattgcaacaagaaatatttctattttaggaagttatattggtcattttacatttgaaccaacaattcaattattaagtagtggtcttgtagattttagaaatatgattactcatcgtttaactttggatgagtttggggtaggacttgatgctatgcgtaagggagaagccttagaagttgttctatatcctaataaataatcaggaagaaaaatcaatttaataataattgagattgtttttggtacgtgctgttttctttattgttcaatggcggtattttaggtagtgttattgaatctactgtatatttttatgcatcaggatttgatgatgctattagcatagaaattgaatgcagtaacttttaaacatatcatggatttatttggtcaattttaatgttacctagatctattctaatttattaaatggtgttacagtaggatttactttatcacaaatgtgtatcgttgtttcattagtatgtttgtaattattcttactgagattgggattgtttagttactatttgatgtattttgattggttgtacaaaaatataaaatgaaagaggtataaatggtatgaaaaaaactttaaatgttggtgttgttggatgtggtgccattggtaaggaacatattaagcgtttaacagaagttgttcctgaaacaaaggttactgctgtaagcgattattttgaagatgttgctaaagaaatagcaaaagaatatggagcaaaagcatatacagatagttttgaattaattaatagtgatgatgttgatgcagttgtgattacatctactgatgatactcatgctcaatttgtaatggaatgtttaaaagtagggaaatatgttttctgtgaaaagccattagctttaactcaacaagaatgtgaagatatgatgaaagcagaacaaaaatggggtaaacgtttagtacaggttggattcatgcgtcgttttgataaaggatatcgcgaaatgaaaaaggcgtttgatcaaggcgaaatcggtgaagcattaatggtccactgtgctcatagagttatgtcagaagcacctggttttcaaacagattatgctattacacgtgtagctattcatgaaattgatatttgtaggtggttattaaatcaagaatatgaagaagtacaagttttaaaagtgaaacaaagtcgtcgcacaatgggagattggttaaatccccaattagtcatgttaacaactaaagatggtcaacgaattgatgtagaagttcaaagtgatggtgcttatgcctatgatattcaatgtcaaatcgttggtgaagatggcacattgaatttaccagatcctgcctttgttaccaaacgttctactcgtggatttgctcataacctcgagaaaagttggatttatcgtttcatagaagcgtatgatattgagttaaaagaatgggccttagctgttttagatgaaaaactaactggtccaagcacatgggatggttatgcagcttgtgtagcagcagatgcgctgataaaatcacggcaaactggtcagcctgaaagggttaatatgattgaaaaaactgatatttataatgatagggaggagaattaaaagatggattataaaaatttaatatcaccattaaaaataagagataaagttttaaaaaatcgtattgttatgccaccaatggaatgtcgtttaaatactattgatggttcaccaacacaagaaatgattgattattatgctaaaagagcacaaggtggcacaggaatgattatcgttgaaaatacttttattgataatcttgaatcacgttcatctgttgcatcatctggtttatacagtgatcatcaaatatggcgtaaagcagaattggctgaagcaatcaaagaatatgattgtgtagcaatcattcaattatctcatggtggaagacaagctaatcctgctgctacgggattagaatgtgttgctccaagtcctataccttgccaagtaactcaacgtatgccaagagaactaacgattgatgaaattcatcgtattcaaaatgattttgttcaagctgctattcgtgctcaaaaagcgggatttgatggtgtagaaattcatggtgcgcatggttatttattatgtgaatttttatcaccatatgcaaatcatcgtactgatgagtatgggggaaattatgaaaatcgcgcaagaatgattaaagaaattgttcatcaaacaagagaagcagttggtcaacattttattattggtttacgcttaagtgttgatgaatggctaggagaaaaaggtttacaacctgatgaaacatgtcgtttagcacatgaacttgaagaaatgattgattatgttaattgttcagcggggaactatgaaactggagcatactgtcaaacaagttcaacatatgatgataaaggaaaaattgtttatctggcagaagaaatgaaaaaacatgttcaaattcccgttattgcagttggatctttggatgttgatttagctgaacaagttttaaatgagggtaaagccgacttagttgcatttggacgtgctttgatttgtgaacctaatattggtaataaggtaaaagaaggaagagttgcggatatacgaccatgttgccgtgctaatgaaggatgcttttctggttttgctaaaggataccctatacgttgcgagttgaatccggctgcaggtcaagaaagaaaatacgcattatataaagtacaacatcctaaaaagattgtcatcgttggtggtggatgtgctggtttagaagcagcacgtgttgcatcgttaatgggacatcatgtagttttgctggaaaaagaggatcatttaggagggcatctcattgaagcagttgctccaccattcaaagataaaacaagagatgctatggactggatgattagacaagtctacaaaggaacaacatctgttattttaaatgccgatacaagtgaaaaggcaattcaagatttaaatcctgatgcattgatcattgctacaggatctcgatatacagttccgccaatccctggtgttgaatatgctatttatgcagatgaagcattattaaaaccagaaaatgttcatcataaggttgttgtgattggtggtggacttgttggggtcgaaacggcaatgactttagttgaagaaaagaattgtgatgttactgttgttgaaatgcttgcagatttaggtggagaaatggatggtaatgctcatgaaacgatgatagcaagactcaataaagataatattactgcaatgtgtcaaacaacagttaaagaaattcaacaagaccaagtggtttgtgaacatgatggaaaagaagttgttattgatgctcaaagtattgttttggctgttgggttgacgtctgatatgaaacaaaaagaaatttatgataaaattgatgtaaataaatggattattggtgatgccaaaagggcaagaagcatttatgcatgtacacatgaagcttgggaagctgttttccaaatttctgatgaatctatacaagattaagattttgataacaaggtttaaaaagtatataaagattactgtaggttatatcagtagtctttttttgttttaataaagtagtggtgatataaatgttgtgacaagataattgattaaaattaagttttagtaaacgtgaattatatgatatgttaattaaatgacatgattaacaatgggaagaatttactattaaaaagttatgattaaaattattaatattagattaatgttgacaattaatcgaagacaaatgtaatttaaattacaaaattatttaaagtaactagattgatagataataaaaatatatacgatttgaaaaaaaatataaaataaaaaggtcattagataagcaagtttaactaatgacctttaaatgtatttgctaaaattacgtcttggattacactaatctaaggtaattaatatatacatattatttatctttaatatgaaatttattcttaattatgataatggaatggaggaagaaaatgaaaaaacaaatatattatcattattattaattttattcatagttatgaacatatttaataattatggaataaataatgtatatgcaacaacaaatttaacattagaacaattaaaaagcaaatttccatctggaaaatattggaatcataacggatctaataatccagatggatatacttcaaatccatgtacacatcatggtaattgtgattattatggcaattgtgcatgtaatagttatgctaatgcaattcaatgtatgggattcgcatttaaattaggatatgatgcatttggtagtaatcctagaaattggagtacgacaacatcattatcaaccttgaaagcaggagatattataagatataaaaatgatacacattcaatttttgttactggtgttgatggagatattgtaacatatagtgattgtaatagtgatggacattgtaagatcagatggaatgctaccatatctaaatcaacaattagatccactttaactagagtatatgtagccccagaaagtttaaaacttaataataattctgattcaacaagcattaatcctatagatttaggtacaaattttactgcaagtatacataatattaatgcaaaaaaacttataaaaaatgtagataccaatgtagaaattgcaactgaaacatgtagtccggctgaaagatggagattcgatagacaatcagatggaagttataagattactaatttaaaggatggattaattttagatgatcaaaattttggtaatactgacgggaataatgttattgttgcagctagtaatgatagtgatgctcaacgttggtatatatataatgggacatctggatatatatttgtgcctaagtgtgcaccagatagatgcttagatgtagaaggtggaggaactgcagataatacaaatgtgagaatttggataaaaaataatacttctgcacaagaattttcaatttggagaatttccactccagctatttcaaatattggagatgatttttatgcaggtattattcatacaaagaattggaaaccattatcaaacatcggagataatgtttgttttaaagatttagaatcaaattcgcaaactctttggtatttcaaacaaagttatgatggaagttatattattaaatccgtttatgatggaaaggcattaacagctgtagaaaatcaagatagaggaaatgttacaactgcaccatatacgggaacacttaatcaaaaatggtatgtattaggtgaatcaggagaatataagttacgccctgtttcatcatcagagttagttttagatttatctacaggtacttatacagatggagttaatgctcaagtatttacatataataatactgatgcgcaaaaatatcaaatatggaaatatgattatgttaatccgtcaatatcaatcaaggttaatgaggaaacttcagaggtaaattttgtttggtggagggtcgaaggtgtaagtagttcaactttaaaaatatggagtggaaatacgattaatggaaatccattatatactatagaaaatataactgaacaagaatatgcaatgaagttacctagtggagagtatactgctcaagttgaagtaattaatgctttaaacacaagaattagtcaaccaaaaactataactgttaatacaagtttaaaaccagagatttttataaataaaaatgaacttacattagatataaatgaaacatttgttttaacaggaagtgttacaaatggacaaaaaatcaattggagttcagataatacttcagtagcaacaatagatagtaatggtaaaattgtggctttaaaagctggaatagcaacaattaatgccataagtcaagatggatctgtttcagttacatgtaaggtgactgttaaagcgcctattgtagaaccttcatcaattatattaaataaatcctttataagtattgaaaaaggagaaagttcagtattaacatattctattactccgaatgatgcaacagataaaagagtgatatggacaacaagtaatactaatgttgtaactgtttcagaaggagtgattacggcagtaggagttggaacagcaacaattactgctgcaactagtaatggtaaaattgcaatatgtaaagtgacagtgactgaaccgattattgaagctgtatctatatcgttaagtagcacaagtctaaatttgaatataggagaaagtcaaatgttactagctacaataactccattaaatacgacaaataaaaatataacatggacaacaagtaatagtaatattgtaactgtttcagaaggagtgattacggcagtaggagttggaacagcaacaattactgctacaactagtaatgggaaaagtacaacttgtaagatttctgtaaaaaatggtggtgttctttcaactgaaaatatagaaactagaaaagatcagataattgaaattccagtatatatagataagaatcctggtattgtagggatgaaaatggaaatggaatatgataactctaaacttgaattattaagtgttgaagatagcggtttattagatagtccaataatgtctaatgatttgacaaaaatgccatatgttttaagttggggcgatggattacaagaagaaaataattataaaacaggaaagctagtaataattaaatttaaagtattagatatatcaggctgttcaacagatgtaatatttacagctattgaggcatatggaactgaccttgttgaaaatgttgagtttagtacagctgtttctaatattaagattaatagtagattgattggagatgtgaatggggatggtgaagtgaaattgaatgatgctttattattaagaagatatgctgttgataatgatgtcattattgacaaggaaaatgctgatgtcaatggagatggtgaaattaaattaaatgatgcgttattacttcatagatatatagcaggatggaatgttggaataaaataataggagagtggttaaaatgaaaactattttaaaaaataaaatcttaaagtggagtgtgattattacaattatattttcaatgtgctgtggaaatattttaaatgtagttgctaaagaaaatgcaataataagtgtaagtaatgcaagtggaaaactaggggaagaagtcagcctcattattaatttatcaaatcttccagatatgggaggaattcaattaatagtggattatgataatgatcaacttcaattgatagattatgaaattgggtcattgattgatagcagtcaggaatttactaataaggattatacaagaaatccatttaaaatgtcatggggtgcaggtttaacaaaatgtaatttaacagataatggagtagctgcaatactaacctttagaattttagatactgcagcttttgggaatacaaatgtaattgtatcaggagacgaaggtaattcttgtgatatgaatttaaacgaaattacactaacttctggtactggtatcgttactattgaaaaagaagttcataatcacgaatttagtgattggaaaatcattaaaaaagcaacatgtacaacaaatggtttgaaatctagagtatgttttgtttgtgatgaagaagaacaagttgaaattcctatagatgaaagtaatcataatgatattgaatatattattacaaaagagcctacatgtgagaatgagggaattgaagaaagaaaatgtaaatcatgtaaaaaagttataagtacatctgttattccagcaaatagacatgaatggagcgattggaaagtcatcgaaattgcaactatatatacagatggtaaaaaagtaagagaatgtaatgtttgtcataagttagaagaacaaataatacctaaaatttctcatggcaatgcagatcatcgattaggagaatgggaaatcatcaaagaagcaacatgtacagaggaaggacaaaaagtgcaacgatgcacaatatgcgaagaaatagttaatacagagattatttcagctaatgatcataagttagaaggatgggaaatcatcaaagaagcaacatgtatagaggagggacaaaaagtacaacgatgtacaatatgcgaagaaataattaatacagagattattccagctaatgatcatcaattaggagaatgggaaatcatcaaagaagcaacatgtacagaggagggacaaaaagtacaacgatgcacaatatgtaaagaaatagttaatacagagattattccagctaataatcatcaattaggagaatgggaaatcattaaagaagcaacatgcacagaggaaggacaaaaagtacaacgatgcacaatatgcgaagaaatagttaatacagagattattccagctaatgatcatcaattaggagaatggaaaattattaaagaggccactaatgaagaaagtggtataaaacaaagaaaatgtgatgtttgtggaaaaatagaagaagaaaaaataccagttattattgcagaagataatactgatcaaaataatataaataacgttattaaaaatcaactgaatttgaacactgaattgaaaaaattaaatgttgttagaactgatgatatgagtaatattgaatacgttttattattaatgtcagtatcattgtttgtaatatggatcttatatagaagaaaagaaataaactagtcattttaaattatgagtaactgctttgagtattaatgcagttactttttgtgttgactgtttttcatcgcgaaaagttaaaagatgaagaaaataacttaatagataaactaataaataaaaccgtagaaatcgttatagaaaaagaatcaaaaatttaatattattttataaaaaaattatggacaattatgtgattaaaaagtataattaagttagcaaaggattgttactttaattaggcaagaccagaaactggaagtttttagtcttgccttttaattttatagattattaacagtagattactgttttaataatgaattaaaaagagaagtaaaaaatttaatgattgtatgaaagtgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactattccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataatccaccgaataacatgaaaggaggaatagtgttttattgtgattaaagaatgatttgatttttatttatctataagataagaaaggaaaaaagaaaaatgaatatgaaaaaaagaagaattaccatatttttactagctcttgtattatccttaacaatgggtgtggcatcaattaatgttcgtgctgaagataatgttgagcgtattgaaagagcattgatacctcagccattgagttataatgtttctgacggaaaatttgttttaactgaagatacttcaatttatgtaaaggggaattctgaaagtgagacagaagaattaaatcaaattggagaacttcttgcaaagatattaagaaaatcaacgggatattctattgaagttattgaaggtgaagctgcaaatggagatattcaactaacaacagttgatggagatacttctttaaaagatgaaggttatactatcactgtaacgactgatagtgtaaaaatagctgcgccaaaaactgcaggtgtgtatagggggacacaaacattaagacagttattacctgctgatattgaaaagagtgaaattgtaaatgatgtagaatggaatataccggtttctactattgaagattcgccaagatatgattaccgtggaacacatcttgatgtagctagacatttccgtacagtagaagaagtaaaaagacatatcgataatattgctcaatataaaatcaatgtcctacatcttcacttgactgatgatcaaggctggcgtcttgaaatcaaaggtgaaagatatggcgaaagttatgaaaaattattaacaattggagcacaatcatcatgtaatggggatccaggtggatattatactcaagaagaatataaagatattgttgattatgcggctcaaagatatattgaaattgtacctgaatttgatatgcctgggcatactggagcagcattagcttcattagactttttaagtcctgatggaaaacctcttgatgcaccaacacaagattatacagttggtaaaacaacatttaattgccgtcttgaagcaacttatgaatttgtggaagatgttatagcccaaatggcagaattatcatcatcaaaatatattcatattggtggagatgaagccaatagcacttcaagtgatgactataattattttatgtcaagagtaacagaaattgccaaaaagtatggaaagattccaatgggatggcaaaattatgatcaaacagatggtacagatgaatcagttgtacaattttggggaacaaggacaagtgcaacaattagcaatccaaatatgaagatcttaatgtctccagctaataaggcatacttagatatgcaatatccaacaaactcagattggggattaagctgggctggtaagatatcaattcaagcaggatatgaatgggatccaactgattatacaaaatttaatcaagataatattattggtattgaagcaccattgtggtcagaaacaattagttctgtagcaggggtggatcatttagcattccctagattgttaggaattgctgaaattggctggtcacaaaaagaagatagaaattggacagaatataaagaaagattagttgcgcacgcagatagattaacaaatgaaggtattggtttctatagagatccacaagtttttggtttacctacttataatgatccaattactattcctaataaatttgatacgtatttgacaggacttgctgatggtatgaatgtatcatataaacttaatgttgaaaaagctggaacttatatggtagaactaaattattctactgataatatttggtctattaatggtcaaaagatagctttatcaattgatggtgaaaaggtggatgaaaagaatcttgcggtaacttggtctggaaatggtgcggtaattatgccaattactgtttctgaaggagaacatacattaaaattagacttctttgcatcaagttatgcattaaattatattaatatttatgaagctcctgttgtacagatacctggtaatgttgaagcagaagattatgtaaatagtaaaggaattaatcatgaaccacgaggaaaccgctatactgtttctgaaacaaatactggagatttcttagaatataaaattgatgttgctaagacaggaacatatactttagcattaaatgcagcggctcaaggtggaaacgcagaggcagatatctatgtagatggtgtaaaagttggaaatctatcatcagttgatactggttcatggagtaattatataattcaggaagcttcaaatgaatttgaattgataaaaggagaacatacattaaaaattgattttactaatgtaaatggtggaacaaacattgattatttagtgtttacagctattaattatgctggtgaaaatacagataaaacagcattacaaattacagtagatacagctaatacattaaaagctcaaggggcattagacaatgttgtaccagctgtagcagctgaatttgaaactgcacttgctaatgcagaggcagttttggttgatgatagtgcagatcaaacaacaattgatacttcattctatcgtttagctaatgcaattcatatgttggaatttgtaaagggtgataagagtgctttagaagccttgatcaatgaagccgaaaaatatgaagaagaaaattatacgactgattcatggacagcatttaaagaagccttagatgcagctagagatgtcatgaatgatgaaaatgctttagaaagtgatgttaatgaagcgttaaataacttaacagaggcaattggaaacttagtcttaagagctgataaaacaagattacaagaagcatatgatatggtaaatggcttagataagagtctatatacagaagctagtgtagcgggattaactgacccaatggcagctgctaaggccgtattagaaaatccagatgcaacacaagaagaagtagatgccgcatatgaagcattgataagagcatacttagacttaagattgatcccaaataaggatctattacaaggattgatcaataaagcagaatcattaaatgccacaaattacagtgctaagacatggtcagtaatgatggaagccttagatgaagcaaaagcagtattagatgatccaaaagcaactcaggcagaagtagataatgctaaagaagtattagctaaagcaatggctggattagaagtaaataatccagtaaaagcaggagatacaacagcaagcgtggctactggagataatggtttaattggaatctttgctagcttatcagttttaagttttgcgggattaagtttattaagaaaaaaagaaaattaatttttataacgatagttagtatttagtatgaaagggtctctaaattttgacagagtttatcaaaataagactccacaatctaatgggagttttagttccctagattgatttagaatagctgatggagtttttccattggctatttttttagtgtatgctgagcatggcatggatttagttggagatagacttatcgccaagtgtagtgaacctcgagccgttgatagtgatgtcatggatgaaggaagttgcgtagcgattctttcaagcgtacgaacagaaacctgatgagactaaatggtggatttggagatgtcttatcaaggattatcagctattttgataatgaagaaagtcattatcatggatttttattagggttatttaatggtaaaaaaatcaaattaaacagagaaacgatgcatggaagatttgatatttgtattttatcaagacgaatttaccaaatagcacttgtattagaatgtaagcattctgatgcagtacgtttacttaaaaaagatatgagtaaaggagtaaaataaattgtagttaatcaatacatgcaagaagtaattaacgaatgtagtgggagtatctttttataaaaaattatgttatatagaaaaagcataatagcctaaaaattgtttgttagttgtttaaaaaacaaaaggagattataaataagaaatttgataaaaacaaaaaacattgaataaatcaggatatttctaaaagatattattgatgatttgaaaaataaaaagaaaaggattattggtattgaataagacacttaaaaatacaaaatagttctagataataaaagtctggattttttcagacttttatattttagagtgtatacaatttcgttatacttttactcttcgttataatatttttaatagtttattttaattgtcgttatgatgaaagataaatcgtttttttaatatgatattaattggaatatccaaaaagattatcatagtttaaaaatacaagcgagttgtacagtgattaaaacaacaaggaaagtatgtatgatttgttgcataggtagtgtaatttattgatagaatagaattttttgtctatatcagatatatgttatgtttagggatgttagtgatagttttatttatatttttgatatatcattatgttcttgagcgtaatttaaaaatgataatgacataaatattttgaaaacggatatgtttatgatttaaaatctaatacgataattaatggtacaaaaaatagtttagtgttataattataaaacattcagatggatgaaaaatatggtttgattgtgatagctaaaaattttatttttagtatgcattgagaaattagttgtaggttgtataaaataatcattggtaattatacgaggagaaaaaatgatggaaataatgagtatatataaaataggtgagtcaaaagaaattgcggatgcaatgtttccgaaacgaaatatttatattgttcatggtttttcgatttttttattgatatatgtattatatttatgttatcaaagtaatttagttactagaatagctttaattgttattgctatagctggtatcatcatattacaatttatcttatttaaacaaaagaaaaactttttacatattatttatgaacgatttcaagaaacaaattctactgatgaaatcatttatcattataagtttaatgatcaagatatggtgataataaatactaatacggatgcccatgtagaaattaactataattgcttttgtcaatatctagaaacgactaattatgttttagtagtttctaaagctaaacaatatattatttttaatagagatgttgctaagcaatatgatttaaaaaacttttttaagaaaaaagttccttctattcgtattcaagaataataaataaatcttataatcagtaaaaagaacaaatagtagtattttatattataaaattgaggtaaaacagaaatgaaaaaaattatattttttgatattgatggcacattgattggtcattcttttactgtgacagaaaaaaataagcaggcaattaaacagctgaagaaaaataactatcttgtttttttagcaacagggagaccgttatcgtatattgaaaacgaaatattagatattggatttgatggagttattgctagtgctggtggaacgatttattatcaaggacagtgtatttatgagcatccgctagatttaaaagttttaaaaaatgctttaaaagttttatataaatatgagattccttatggtttagaatgtaaagattattattatacgggatttgatttgatcaataagactattgatagacaaataaaaagtggacaagataagaatgttgttattaataaatttaatcaggtaaaatataaagatattcagtactttgattttgataatccagtttcaaaattaagcgcgatcattcttgatgaaatacagtatgatatgttaataaagtatttaaatgatgattttaaaattgtgcgatatggctttgcagttgatattattcaaaagaaatggaataaaggagatggagcaaaatatattatgaaatatttgggaattgattttcaagatagtatagcatatggtgatagtcttaatgatctagaaattatgaaagttgtagcaagaccaatcgtatatgaaaaggcgccacaagaattattagatgttgcgattgatacttttattgatcctgatcgagatggtatctatcatagtttaaagaaattagaaatgatttaatagtactggttgatcttttgtcgttaattatttaaaatttaattcttatgaatcaattgtcaaaaatcattaatgaacttattatgtagataagttcttttttgaagatttaaactagtaatgtttatcaaataatatacttttgtgcaatgtcttttaatatggctataataaagtagataagatgatttgataaaattttatattaagtgttttgaaaattgaaaaaagtcaattttataatttttatatactattattgacaataaattattattttgatatgattttatcatagtttaaaacgtaggaacttaaaattataaaataaaggggaataataaaacaccaaaaatcagggattattttagactagtgaagctagaaatcatttttaggctagtaaaaccccataaaatcaatattttcattgttgatttctagtatttttgatataataactttataatattctgttttacccgcttttgacagttcaggggcttttgagaaaataaaaattcgggtttgtccaggtgtaacctgttacaatttattttattaaaatgtttcaaaatgggggaagttatagaggcggataaaatagaattttataaattgaatggtgcaataaagcaaaggggtctgtgtaatgggtttcacacacagaagtaccaagttttggatatgccattcttgctttaaaaagttaactatataaaaatcaattgattttattaaagttagcaagtatttattaggacattaaaaagtgaataaaagtgtacattgaaaataactatttctgcagtttttaaacattgataaatatttttcatgtgttttaaaagcttggcattaaacttagtgtttttggataaaagtttatagataactcctaataactttcttcattgattaattctgtatacatctatgtgatttacattgagtgcattttaaggtgtgaaagtagaattgatttgcatattggtaatatacactgatacaaggctttacgaagataacaagatctttgtttgggtagcattgtatatcaccaattttatttaaaatgtatttatttgtataaatttcatactaggaataaagaagataggaaagttaagtagatttatagacatcttaattttatcaattatcttttatatgaaaaacattaagattcatggttctttctatattatcaaaaaaaggtatttttaagatgattcgaatgagcattgctaaattcttttataaattcatgtaagacctggaatattttgatttgaacaaggaattgaattcaggggaaatgatatcatacatttttgtagttgatttttaaatctgttgatatctttcattaaggaagatgttgacaagtgagttctttcctttatttcaagttgatgtttggtaacaggcagatagtttctgctggggatgacttgagcaatgataaaagtattagttttatcattctttacatatttttcttacatctagtgttaagagaaatgaggatatgggattaatttgattatgaattaaattggtttcataacgaatagttgctttaagatcgattatatgatgaggatttaaaaatatatttaacaaaatctttttattgaaaaacttcatctaattaaatttaccaacatcaatagaaataaaatttatataaaacatattcttttgtatttatacgaatatgatagccacatgcaaaggattaaagagcttaattagatacaaaaagcgctgataacttttctacgatggttatgcttcagaaagggaaaatcaaagtatactttcgtttttgtagttctaaacaaaatttaaagaaaggaaagaggtgtatcatttatgactatttaataatctataaatggtatactggggaaaaatgaatttatgaaaaaaaattcagtcaagaagtttttagtgggtgctcttgctgtaacgacagttttcagcatgtcatttacagtagacgcagcactaaacagcgaaaccactcctgcgagtcttctagatgagctcactgcgggaaatgcaatttccactaaacagtatgagccagatgatgtcgtaactgtaattgtggaattagatggggaaactaccctagatgtagacgaatatgttactatgtttcaaaataacagtattggttattctgctgatgcgtctgtggcagcttaccgtgcagatatggtaagtcagcaagaggagatagaaactcaaatttcagcatttgctcctaatgcgacatttaagtatcactatactaacctgcttaatggttttgcagtacaggttgagtacaaatacatagaaaagattgaagctttggatggagtaatgtcagtttatctaactcaaagctacaactatgatgataattgggaagtaaatgaagaggatgcagaatacatgtctctagaagagtattatgagcttactggagctgatgcaatcgacttgagcaagtctgctacagctgatgctggttctactagtcagatgggtcttgaagctgcttgggatgcaggttatactggtgccggtaaagttgttggtgttttcgacagtagtcttcgttatactcataagttattttcttatatggatccagaaatagaagcagatggtgaaaatggtttactttctaactataaaacaaaaaataatctgcttgaatctatcaaagctaatcaggatactttgaatctatttgtatctggttggggaagctggttccatggttatgatgagactggtttttcaacagatatacaaaatgctattttgaatggtgatttctattacaattctaaagttcctttctctgttgattatgcttgcggtgatttggatacatgggatggagattctagtagccatggtacacatgtcagcggtattgttgctggtaatggtggagaaggttatgatgaaacttctggtgtcaaaggttctgcctatgatgctcaaattatgttctttaaggtatttgatgaaaatgatgactttggtcaagaatctgatgaagctgtatttgccgctttagatgatgctgttactctaggtgtcaatgccttcaatttatctcttggtatccctaacggatttacaactatgaatacttatgctcaagcaggttatcaacgtgcttataaccgtgctagtgctagcggtatttctatctgtgtttctgcaggtaatgatgctcgtgatagtcatccaggagctttagtaagcggatacactactttattacctaacagtgcctcagctggtttctctggttcattatatgcacctatgactattgcttctgctcaaggtactggttattcttatactaacaattggacagatacagttgcagctgctgtaaatgcagatggtgaggctgtaaatagtgttacaatcacagatatttatgaccctgcattgggtgatacattgactggtacttatgagttagttgattgtggtgatggttcttctattacacaggatttaactggtaaggttgccttagtaaaacgtacttatggttatgttccttatgatgaagaaggaattaaagcagcacaacaaaatgcttataatgctggtgctgtggcagtttatatgactttcgataactacagtagctattttggtactaatggtttatggactggtgaaaatggtgaaagtattcctgtttttgctggaacagctactaatagcagtgtttatactactttatctaccgctcttgctgatggtactgtaaatgtaagcttctcttctacagcgcaatctcagcctgtagctcgtagctatagtgatactggtccatcaagctttacttcttggggtgttactgaatctatgaatttaaaaccagatgtaatgtctccaggtggtaatatttggtctgcaggagcatcatctgatactgctttatcttcaaagagtggtacttctatggcttctccaaatgcagaaggactatttattcttgcacaacaatatgtagatgataatctagatacttttggagtaaaagttggaactcaggaatattctaatttagtaaatcaattagtagcttctactgctgtagcttatcaaccatttgtaagctcttcagatttgactcgtcagaacttgtatttctctccaagacgtcaaggtgctggtatggtcaatatcgataatgtgatcaacagcttagttgtgttacacaacgaagtaccttataatgctgttactggtgaagctcctcgtgctaaagtagaactaggtgataaattaggtacaaattttgatattaaatttactatggataattatgattctgtagctaagacattcgatgtattagcatgtcttcaaacagacaatactacagaagctaatggacgtacaaatcttgcaggtgttaatacttatggttcagatattgatgcaatcgaagatggtgtgatgaaagtaactgctgtttctggtggtactgttgttagtgcatctgataacatcaatcgttatggtgataatgcttctgcaacacaaatttctgttcctgctaacagttcagttgaaattacagttaatgtaactttgaacgaagaaacaatgaatgcttatgatgcaaaataccctaacggtatgttcttagaaggttttgtcttctttgataatgtagattctgattatgaaactcttagcattccttatatgggattcagaggagactggaatgcagctccaatcttcgatttagctactgcttatgatgacattagcggattagctacttctgatgctaattatcctttattctacacaactactttaaattctctagttgatggttatgatgtggttttaggtgcaaaccaatttactggagcatctttaccagattattttggaggatcttcaacaagttattataatacgatccgtaactatttaaataatttacgtgatggtggagaattaaatggtgcttatgctactatttctccaaatggagatggtaaggatgatatcgcttatgcagcactttatttattacgtaatgctaaagctttatgtgtagtaatcaaagatgaagctggaaatgttgttaatgtaattggacctgaatatgaatattttgaagcaaaagttaatgacggtaatttaacacaacaagctgctttaagctatggaactaaatataatcatcaaatgtactgggatggtactgatcttgatggtaatatggtaaaagaaggtacttatacttttgaagttcgtgctatgttagaatatgaatatttaaattctgtagattatggtaatgatgattcatgtctagatgctttgatgaattctgataatgttcagactcaatcatttaatgtaaatgtagacgtaactgcacctaaagttgattcatctttagatggtgatgttcttactattaatgctagtgatgcatctggtatccaggctgtagctgtttatagtaatggtactcgtgttagtgatattattcgtgtaaacaatactgaaacaactacaacaattaatttaagtgacttggctgaaggttatgataagaataatttagaagttcaagttgtagattatggtatgaatatggcatcttctaccgtaaatttagttgatgtaaataaaacagcattacaaattgctgttgatacagctaatacattaaaagataatggtgctttagaaaatgttgtaccagttgtagtaactgaatttaatgaagcattagctgaagctgaaagtattttagcaaatcctagtgcaagtcaatcaactgttgatacatcattctatcgtttagctaacgctattcagatgttagactttattaaaggtgatacaactgctttagaagacttgatcaataaagtaaatggttatgcagaagaagattatacaacagattcatgggcagcattacaagaagcattagatgcagcaaaagaagtagctgcagatgaaaatgctttagaaagtgatgtaaatgaagcatttgataatttaacaaatgcaattggaaacttagtcttaagagctgataagacaagattacaagaaatgtatgataaagtagatggcttagataagagcttatatactgaagctagtgttgcaaatttagcagaaccaatggcaaatgctaaagcggtattagataatccaaatgcaactcaagaagaagtagatagcgcttatgcaacattgacaagagcatacttagacttaagattgattccaaataaggatttattacaagacttaattaataaagcaaatggattaaatgcagctaactatacagcaaaaacatggtcagtagtagaaagtgcattagaagaagctaaagcagctttagataatgaaaatattgatcaagcaggtatagaagcagcatatgaaaacttaatggctagtatcaatggattggaagtagttgcttcaggtgatacaactgtaactacaggaactactggagcaaaaggatcaatcaatactggtgatacaactagtatgattagtgcattaggattattagcatcattaggtgcaattgcttatcttaagagaaaaaaatataattaatattaagtttgatatttaaagctaccgagttttgacttggtagcttttctattaacatctaaatatcaatgatgctaaatttttataatatattgcatcataatagatgatgaatattttataagttattgttatttagtaaaagtaataaaatatcataaatatcaatatttatttttcttgttttttattggaataaatggcataattattaaaaagaaaggatgagtgccatgttacagcaagaacgacataatcaaatactcgctagattaaatttagaaggacaggtacgagttaaagatttaagcaaagaatttgatgtaacagaagattgtattagaaaagatttaacgatcttagaaaaggcgaataaattgaaaagaatccatggtggagcaactcagctgcgtgtgaatttacatactataaatgttaatgatcgtagagaaattcgagttacggaaaagaaaattattgctcaaaaagcaatagaacttataaagccgggaacgatggtttttttaggaatatcaacagtaactttagaaattgcaaaattaatataccaaagaaatttaaatgttacagttgttacaaatatgatcgatattatgaaaatatttactcaggattgtgcaacacagttgatttttattggtggaggcttaaatagagctagagatggttttattggttcgattacaataaatcaattaagaaaatataaatttgatttatcttttttaggggttgtaggaatagatgtgtataatggcaaagttacgacttatgatgtgaatgatggtttaacgaaaaaagaagttattcattcaagcaagaaatgttatatggtcgcagaaacagctaagttagaattggatggtaattatgtatttgctgatattggtgattttaatggctatatttgtgaagtgggtcttgaaattgaaatggaaaatagaatgaaaggttatggtttggaaatcatttgataatgatttcttttttattgttttttatcgaaaaattatcgaaaattattattttatacttgaattatagtgattttgaagtataatataattagaaaacaataaaaaacaataactaaggaagggataagatggagagtttaattcaaacaggaagaattgatattttgaaagataagatgctcaaagccccgcgatatgcctctattgagcaggcaagaatcattactcgagtctatcaagaaaatgaagaattatcgattcctaaaaaaagagcattatctttaaaaacggcattagaagaattagaaatcagtgtagaaaaagaagagctgattgtaggaaatcgaactaaaggggtacggtatggtgttgtttttcctgaaagtggctgttcgtggatcaataaagaatttgaaacattgccttcaagaccacaagataaatttttagtaagagaaaaagatattcaggaatttagagaagaaatctatccatattggaatggaaaatctatggaagatgtaattaaaaacaattatggtaaagaaatcaatgcaatagctaaagttgtgaaaataaaccaaaaggatcatgctcagggtcatatttgtccagattcagcattatggttaaaattaggaccaaaaggattaataaaaaaagctcaaaagaaattggcggaatgtgatgaaagtcaaaaggaattttatgaatgcacgattcttgttttagaaggagcagtcaatttcatggttaggtatcatgattatattatgaacatgatggaagaagttgaagatgaatatcaagattctttaaaaaatgttgctaagatttgtatgaatctttcgaaaagaccgccagaaaattttcatgaagccgttcaagcattatggtttttgtttgttatcttgcatatggagtcaaatgcttcatcgttttcaccgggaagaatggatcaatatatgtatccttattatcaaaaagatcttattgaaggaaaaatcacaaagcaggatgctttagaaatcttagaatgtttatggttgaagttcaatcaaatcgtttatttaagaaatcaaaatagtgctaaatattttgccggttttccaattggttttaatattgctcttgggggattagatgaatttggaaatgatatttataatgaattatcactgttgtgtttaaaagcgcaatatcatttaggactgccacagccaaatttatcagtacgattaaataaaaattcatctcatgaattaatgcatgaggcaattaaagtcgttgctaaaggaagcggaatgccccaatttttcaatgatgaagcaatcgttcatgcaatgatcgaagatttaggaattgaaaaaaaagatgctagaaattatgcaatcgttggttgtgttgaattaacgactcatggaaataatttaggctggtctgatgccgcgatgtttaatttaaataaagcattggaactaactttaaataacggaaagtgcttattgacaaatgaaaaaatcggtttagatttgggaaatcttgaaacatatgaaacatttgctgatctagaagcggcatttacaaaacaaattgattattttattgaggcgatgatgaaagctgaaatcgtagttgaaaaagcgcatcagaattgtctaccatcagcttttttatcaaccgttattgatgattgtttagaaaatggtttagatgtgacgtgtggtggggccaaatataatttatcaggtatccaaatgattcagattgctaatctagctgactcacttgcagctattaaaaagttggtttatgatgagcagatgatttcaaaacatgaattattggagtcattaaaagctgattttaaaggccatgaaatcacacaaacaatgctgttaaataaagttcctaaatatggaaatgatataaaatgggttgatgatctaggagctaagtgggctggctattttagaaaaaaaatgaaagaatatcgaaattatcgtgggggattatatcatacaggaatgtatactgtttctgcacatgtgcctatgggtgaaaatgtaggggcttcaccagatggaagaaatgctttgacaccacttgctgatggtggaatgtcaccggtttatggtcgtgacatggctggaccaacagcagttttaaaatcagtatcacggatgaatgattcttatactacaaatggtggattgttgaatatgaagtttttaccagaattttttaattccgaaacgggaatgatgaagtttgaaaatttcttaagagcatttgttgatttaaaaattcctcatattcaatttaacgttgtaagacgtgatgatctgcttgatgctaagattcatccagaaagacatagatcattaacgatacgtgtcgctggatatacggcatattttgtcgagttagcaggaaagttacaagatgaaattattgaaagaacagcatatgaagatatctaatgtgttaatatttgatatcaaaagatttgccgttcatgatggacagggattaaggacgacggttttttttaaaggctgtccgctaagatgtaaatggtgtcaaaatccagaaggattatcattaaaaagaagaccgctatattttaaaaatagttgtattcattgtaaaagatgtgaacaattttcaaaagaaaatcaaatgatttataaaaatgatcgtccctattttaatcttcgttataaaggggattttgataatctgataaaagtttgtccagctgcagcaatacgttacgatagtgaagagtatgatattgaaaagttaatagaaaaaatcaaagaagatctagttttttttagagatgatggtggtgtaactttttctggtggagaaccgctcatgcaaggtgagtttttaaccaccatattaaaaaaatgtaaagaagagggaattcatacagcgatagaaacgactctatatgcttcattagatttaataaaagatattttaccgtatttagatttgatatatgttgatttaaaagtttttgatgaaaataagcatcaggaattaacaaatgtttctgtaaaaacaatcaaagaacatattcgatatatattagaaagtgaacataaagataaggttattatcaggacaccattaatacctttaatgacggcaactgatgaaaatatcataaatattgctagttttatagtggatatttatcctgaggtaaaatatgaattattaaattataatcccttagcggcatctaaatatgagcttgttgatttggaatatccaattaataaacattataaaatgtttaataaaaaacagatgcagcatttttatgatcttgtttatcaaactggtttaaaaaatttaattattgaataggagaaaaaagagatggaatttattattgatacagtagatttagaagaaatcaaggatgctatagatcacatgccaattactggagtaaccagtaatccttcgatcgttaaagcaacaagtcctaaaaacttctttgaacatatgaaagaagtaagaaagatcattggtaaggaaagaagtctccatgtccaggttatttctaaagattgtgatgaaatagtcaaagaaggtcatcgtatcttagaagaaatcgatgatcaggtatatattaaagtaccggtatcctatgaaggtatcaaagcgataaaaattttgaaaagtgagggacataatgtaactgcaacagctgtatatgatttaatgcaggcatacatggcgctagcggcaaaagcagattatattgcgccatatgtaaatcgaatcggaaatttaggaagtgatccatatgaattgatcaatgagttatcaaatcgaatcgttatggataattatgaatgtaagatcttagcagcaagttttaaaggcctccagcaagtacgcgatgcctttaatgccggagctcagagtgtaacagcgccagtagccgtattgaaacaaatatttgcaaatccaaatattgaaaaagcggtaaatgattttaataatgactggtacgatgtttatggtaaaggcaaaggaatttgtgatttataaatataaaaagcaagtcaaaaagacttgctttaattttttaaaagataagatctaagctgttatgatgcatttacgaggacatttttccatacatatgccacagtttgtacacttagtataatcgattcgtgctaatgagttttcaatgataatagcattattaggacaatttctagcacataaaccgcagccaatacagctaacactgcaattttttcgagctcgtagagctggctctttagaattgcatttaacataagcttgtttttgataaggaatcaaagaaataacattattaggacaaattttgagacatttaccacaagcttggcacaaatcaggatcaactacggcgacaccatcaatgattgaaatcgcattatattcacatatttgaacacagctgccataacccatacagccatgactgcattgtttatcaccaccaccaggaacgatagctgcgttattacagtcttttacaccataatacaaatattgaatcgttgcatttttacaagtaccgccacagcgaacaaaagctcgcatacggattgttgcttcactttcaacacccatgatttttgcaatcgcatcagcaacatttttgccaccaactggacattgattgactttagcttcgccagtaacgatagctttagctaaaccatcacagccaggatagccacaaccgccacaattattaccaggcagttcttcacgaatctgaatttctttttcatcaacggaaattgagaatttttcactagcaatcgtaaggagaatagcaatcagtaaaccaatagttccaacaagcaaagttgcaattataacatcgttcatgtcattgtctcctttctatatcaatcctgaaaaaccgataaacgcaattgccatcaatcctgctgtaataagaatgatcggggatccttgaaatgataaaggtatatcattatcagcaatcttttctctaattccagccatgattataatcgcgatcgtaaatcctaaagctgttgaaaacccgcagactaaactagttaaaacatcataattattttgaacattggtcaaagctacacctaaaactgcacaattggtagtaattaaaggaagatagacacctaaagaactgtatagtcccgagctatatttttttaaaaacatttcaactaattgaaccagggcggcaattacaaggataaaagtaaccgtatttaaatattctagattaaaagctgctagaactttataaagcaaactggtgacaaatgaggctattgacattacaaagatcacggctccccccataccagctgcagtttcaatttttttagaaacgcctagaaaagggcataaacctaaaaactggcttagaacaacattatttactaaagcaacactaattaaaagtagaatcattcctttcatctatttttcctcccttaaatcacattgactttcttcgttgtggctatgacaatgaagacaatcgtgattacaatcattattttttaaattattagttgcactaggtaattttaagcgattttggatagctgttaaaccagctagaacaaagaaagctcctggagccataacaaatattgcggccggttctaattgagcaaaaaagttataaatattagaaccagctatatttttaaacaatggtgcaaattcgattccaaaaaaagtaccactgcctagaacttccctaatcaagccgatacaggtcaacgctagagtaaaacctagtcccataccaattccatcaaataatgaaagaatacagttatttttagaagcataggcctcagcgcgtcctaaaataatacaattaacgacaattaagggaatatagatacctagagtatcatataatgatggtaaatatgcttgaagtagtaattgtacgatcgttaccattgaagcaacaataacgatatatgagggaatacgcattctttcaggaatgatctttcttagtaatgaaataacaaagttggaagccatcaagacagctgttgttgttaagcccattcctagaccattgatcgaagaagttgttaccgctaaagtagggcacattcccagcattaagatcaaggttggattttctttgatgattccattataaagacgttctatatatttattcataaacgacctccttgatttcctgattgatcattaaagctccatttatcgcattattaaaggctgatgaagtaattgttgcaccactgagagcatcgatttcctgttcgttttgtttgccagttttagtgataataaagtttttaaccgatttattgtagtactgacttttaaaactttcatttctagcgttcattcctaaaccaactgtttcatcaattgaaagaacttcaatacctgttattttatcttcgctgtcaattccgacaaccaaggtaatatcgccaccatagccatctttagtagtaactttgatgacgtgaccaattaattgcttattgtcatctatagctttcaatacatcatcaataacaatgccgttatcaccaaaataataatttttatttttaatagtttcgggaaatttttttactatatcatcaatttgttgatcgttttcaaatgttttaccatttttaaaaacactttgatatgaatcctggatgactttttcattttggattgcaatcggttctttagtaagaagattgacacaagctaaagaaaaacctgctgttatggtaatgattacaaagatgactatatctttgaaaaaactttttttcatttttgcttacccccactgctctttattttgggtactgttactttttcaatcaacggcactaataagttagaaataatgattgcaaatgacatcccttcaggtgaattaccataaagtctaaatactgctgctaatattcctactattaagccaaaaactattttaccattaggggtaatcggactagttacgtaatcagttgccataaaaaaggtaccaatgataaatcctccaccacatatttgtttcaataaataatcaaaattgcaatctttattaataaagatgatcaaactaaatgatattaaaactgctagtgggatcttaggactaataacttttttataaatcaaatatcccgccccgatcaataaagcaattactgatgtttcaccaatagtaccactagtatttccaataaataaattaaacaaatttacatcctgtccatctcttaataaagctaagggcgtagcactgctggttgcatcgatattaacaaaagaattcatttttcctgcaaatgaaattaatagaaaacagcgggctgctaaagctggattcataaaattttggccaagaccaccaaataattgtttaacaacaataattgcaaaaacactgccaagaactaccatccatagtggaagagaacttgataaacacaaggctaataaaagacctgtaattgcagcggaaccatctttaatagtaataggtaatttcatcagtcgctgatacaaatattcacttagtacagcgctaattacagcaacagttataactaaaaaagcatcaagaccaaattgataaataccaaaaatcgttgctggcattaaagcgataagaacatcatacataatatttttagttgtaatagaactgcggatatggggagcagtagacacattaaatagattatccattatttagctcctttctgacgatcatcattgattgccttttttatttttttaaaagattgggtcatatttcgtttagcgggacagatatatgtacagcagccacattccatacaatcactgccatgtacttttaaaaaattatctttatcaccatttttagcataacgatataatagctggggaattaaaccaattggacatacagaaacacaacgactacaatgaatacaaggggtaggggtgtttttagatacttcgtcttcacttaaacaaacaagcgctgatgaagttttagaaaccggaatttctaaattgaataaggctgttcccatcataggaccacctgaaattattttttgcggatgtatcttgaagccatcacaggcatcgacaagaatctgatattttgttcctaaacgaactctaaaattttgtggtttactgattacatcaccagtgacggtaacgattttttcaattaaagggatatttaaagctactgcatcgtaaatagcgataattgaagctacattactgacaatacagcctacatcagcaggtaacatgccgttttttatattttggttagtcaatactttaattaggacacgttcgcttccttgcggatattttgtttgtaagatggcaatttcaattttaggttcatttttaatagcattttcgatttgacttatagcatcaggtttattatcttcgatggcaataattgctttagcgtttttaaacagctgtaattggattttgattccagcaattagtttttcggtttcttcgagcattaaacgataatccgaagttaaatagggctcacattcagcaccattgataataacatatttgatggcatcatcatctttaggcgtatttttaactgcactaggaaaaccagcaccacctagtccgacaattcccgcatgagcaattaattcgcgaatttgagtactactataattttgataattattaatagtattatattcaggaactgtttgatattggtgatcattagttataataatacaatcagtataaaaaccatttgccacaaggcgcttatcgatagcttttactgttcctgaaatagaactggcaacattggcagagatcattccgctgccattggcgataatttgtccaactaaaacatgatcaccttttttaactgttgctttagcaggggctccaatatgttgagataatgggaaaattaattcatctccaggtgataatgtccggattggatgattggcagaaatgaatttattatcgttagggtgaataccgcctttgaaagtaaattttttcatattaatgactcctttttgaggtatataagttaattataatctctttttttaggatatggaataaaaaatcaagaaaaaaaagcaacagcttaagctattgcctaaagatggaactgggtctcatttaaacgtaaactatatccttgcggatgtttgcatactggacagacggtaaccgcttcgtttccttcgtaaataaaaccacagtttaaacacatccatttaatattattgttttctttgaataatttaccactagttaataaatcatggtatcttttaaatctttcatgatgataattttcaatttcactgatcataaaaaaggttgttgcaatttcaatatagccttcttctttagcttcctcaccaaattgtttataggtcgatgtagcttcatcatattcatgtctagcggctgcatcaagtaaagaagctagatcttcgtttatatcaatagggtaattggccatcattgaaacattttcatctttaaaaacatcttttaaaaaattgtaaaatatgacagcgtgttctttttcctggttggcagtaaaataaagcatatcctgaagtacaggtaaaccactttttcctgccactttagctgctatttcataacgcattcgagcttgacactcacccgcaaaggctcgaagtaaatttgtttttgtttttgcatccatataaattacctccttctttatttttaacaaaatgaagaaagcttaaacagaatattaatatcaatgaaaaataaaaagcaatatctatatcaatattgctcatctaattaagtttatctttattcatacctgttaattccatatattcatttttaacattttgtagtaattgcataaaagtccaatttacatttgtttgagtaacaacagcttttaaaggaataaaaggaatattagcttctttaaagatttgtaataagatatcgatttgtttatcttcaaatcccgccatcaccatcatatcatcaggaggaataacagttaaagcttcggttcctctttcaaatccttcaccacctaagatatagccaaggggactcattagatcacttgtttttacaataattacttttacatttaatttctctaaaattgcaataattgctttacctgcttcacttttatcaatattatataataatacagtctcttgcataaatttgcctcactttcactcattagattatcataattacaaaaatcaatcaactaacatgcatgatatttagatattattagttcttcgtaatactaaaagacaggctgtttcataacttgaaaatttggtttttagactatctttggtgaatgaatatataaatcgacgtttttattgatggctgcaagtcattatctaataacgaataataaagtatataacgtatatccagctaagtaagccatgaaaaatagcccagccaacactatgccatgttgtataactgattaccattgctaaagcactaccaaaagtaattcctgatgtgactgttttttttacgacacccgtcttattttcttccatattctgacctcttaaattttattgatttctttatagataagtataactacttgtactattaaatacaagtaattatctaggatagttacagcttacgatcgaagtcataaaaaacccgaattgcaagcagagagtggaaataagataaaaaagttctaatttttatagaaaatcgtatttttagttataccaattttagccagttctttgacaaatagctgttctgcaggaagataaccaagtatcttccttttcttttgattgattttttgattaatatctaatgttttttctttatctattgtattaatatcagttcctttctttataaaatatcttataagtccattgcagttttcatttgatgccctatcacatgaatgatatggtctcccaaaataaatctttgtacgctgttcttttgatcctggtttcttttccatatccttccatctggcaaattcatttccattatcgaatgtaatggatctgaatattttcttaaaatcgtcaccataaaatttatgaagcttattgatctgcatataaacttttttagaagattttgatgtaataggaatcatataataaaatcttgtttttctttcaatcagggtcaaataggcaccattttgtccatctcttggaccagtgacaagatcaccttcccagtgaccaaattcctctcttgtatcaacgctttcaggtctttccatgatagaagttcccttctgtcttttagggatataagttttccagttctttttcgtctttcttcttagcattctaggcagatcaattggttttatcgaaacttttccttcgtgtatgtaattatagaaagtcttagtagaaacagttaccatatttttaattttatctttttcatgaaggcgaagataattgatagtctcatcaacagaggaaagtctatttgatttcatttcattttcaacgagagtgataaaatcatgagccttatgaagtttagaattgttaggggtcttatggatcttagatcttttttcaaaggcagccaaagcagaaagttcagtacgttcattaagataggtatctctaacagtgatagtggcatccttaatgatagaatagacattagagacagaagtaccaacagaaacagccaaataatgaatgaattgagttttaccgatattacgcttatgaccagaatgcagagcgttaaaacgaataagttcattaacaataaattcataatgaaaaaactgaaggtgtttatttttagatttttgtgatatagtataagtgttcatagagagtctcctttattaggttttggtcgactaaaataatacgacttctatgaacatttttcatgtaaaaaattaaaaattgagactagagggagttggcggcgaaatgtaatgattggctagccaatcattacattaccttaattccagtttcattttacaatacacagaagtcataaaaaaacaaaaaaatattgacgtagcctaaaaaaaagtgtatgcttattaagcaacaaatgatagcagcacatagagttttgaaacgagcgtttataactaatgtttgtaaagtagctggctgcaaagtgaaatacttaatataaacacaattcaaataatctatgcaatgttattgttttatgcaaataaaacaataaatggaggaaaacaaatgtcacgttatactggaccacaatggaagatctctcgtcgtttaggattttctactttagaaactggaaaggaattaagcagaagagcttatgctcctggtcaacatggtcaaaaaagaaaaaaacaaacagaatatggattacaattagctgaaaaacaaaaagtaagacatatgtatggagttaatgaaaaacaattccacaacacatttaaacaagctggtaaaatgagcggtattcatggttataacttcctttgcttactagaaagaagattagacaatgttgtttacagattaggttttgcacctacaagaagagctgcaagacagttagtaaaccatggtcatttcttagtaaatggagttaaaactgatattccatcttatcgtgttaaagttggagatgttgttgaagttaaagaaaaatctaagaatttagctgttattaaatctgctttagaaaacagagtacatacacctgctttcgttgaagttgatgaagctaaattaagtggtaaatttgctcgtttacctgaaagatctgaattgaatcaagaaatcaatgaatcattgatcgttgaatattataaccgtatgggttaatccgataggattatggtatatgctatctttgcagagggtagctatacctttttttatgcgatttaataaaaatataatgtattagagaaaattatttgatataatataagtcaatatggaggtaattatgacagacagtagaatttgtatagctttggattttcaaaataaagaagaagtaaaagaatttttagaaaaatttaatgatgaaaaattgtatgtaaaagtgggaatggaattgttctatggtgaaggtatcgaaatgattaaaatgatcaaagaaatgggacataacattttcttagatctaaaattacatgatattcctaatactgtaaaaagtgcgatgaaacagctggctaaattagatgttgatatggtcaatgttcatgcttctggtagcaaagcgatgatgaaagcagcacttgaaggattagaagaaggaaaaacgggtgataaaagaccagcatgtattgcggttacatgtttgacatcattagatcaagatgtactagataatgaattattgattcatgaaccgttagaagaagttgttttaaaatgggctcaaaacgctaaagaagcagggttagatggcgtagtttgttcaccgttagaatctaaaatcatccatgataatctcggtaaagagtttctaactgttacgccagggatccgtctagtagatgatagtgtaaatgatcaaaagcgagttacaactccagctatggcacgagaacttacttcaagttatattgtagtaggaagaacgattacgggatctaatgatccatatgcaacttataaaaaagtgtatcaagattttcaagggtagaggagaaagatgatgaaagaattaattgccaaagatttattagatatcaaagcggtttttttgagaccgaatgaaccatttacatgggctagtgggataaaatcccctatttattgtgataatcgtttgactttatcatatccaaaggttcgtaaagatattgaaacaggactagcaaaattaattaaagaaaattttcctgaagcggaatgtttgatggggacagcaacagcaggaattgctcatgcagcattaacagcagaaatcttagagttgccaatgggctatgttcgtggtggagctaagagccatggacgtaataatcgtattgaaggtaaagtagaacctggtatgaaagtcgttgttgttgaagatttaatttcaacaggtggaagctctttggaatgcgttgaggctttaaaagaagcaggatgtgaagttattggattagtcgctatttttacgtatggattacctaaagcaactgttaattttgaagctgctaattgtaaatttgttactttgactgattatgatacattgattggggtagcaaaagaaaatgattatattaaagaagcagatattgaaaagttaaaagcttggaaaaaagatccaagtgatgaatcttggatgggcaaataaggaacagttttgaaataaccccattgaaccaagtgaacaaaaagtagaagtatatgagaaatgatgaaataatgaatgtattaatcaatatttgagaatgtaaaatgaactgtgtaagttaagagtgtacggcttaacttgagtaatttaataatttagggacagcctaaaaaatgtctaaataagcttaaaggaacaaccagaaatttgatagttgttccttttgttatgtctcgatacttttttatttttaaacttcttttttgattttggagtagattttttctattagcccaaatcaattggatataaaccgccaaatgaatacgaaaaagaatgtagattagctttaactaataataaaaattatttaataaattcaataatttaagttgtctgaaatcttggcatagtaacagccagcattatacttgattttacgatcagcagaaatcacggagatgaaattatgtattttaagatcatgatagattctctgaaaaaagaaataactgatattgacagatttagatctggcaacaatgagacatttattaaaatcaatgtcaacatttaggggagaaagagcattgtcaaggcgaagttaaaatcatcaacgacctgtttagcataagcaagaggatcatcggtgattttaagaagtttactatgtttactgattcttttaatgtttttagtggtatttttatatcgttgctaaaatttttttggatataataaatagtatcaggataatttttgttataagaaagtttcataaaagaacttttttcaatatatcatacattgaatatgagtatcatgatatattgcaaatggaaaaatagtaatgtatcaagcatttaaacgatttgattaaatcattttatcaagacctgaaatactatatgtattcattgacggttttcagagtttgatttataataaaattagaaaaaaatatagagtttaaataaaaaaaggataataaaagttattgttatttctatataaaaaaggatatgatattatttattgttgttttcatcaaaaaaagaggggagggaatgtaaattatacacgtgatttttcaaaagggaaaattgcggaatgacttttagggcttctgttattaaagtgaaaatgaaaagttatatttagtacaaatatcgttaaaaattgtgaatatataaaggaaattgaaaaatcatatacagaattataatataacaatatatgactgtaatttaaatagtagtgatgaagattatgaaataaatcatattatattgaaaaaagatttccagaatttaaaatagccccaagtttattttggatagataaataaaaacttattaacttttgagattgatgaagaggagaaacagttagataaattggttatgaaatttgaagttgataaaaaataaaatttacgtaatgtttttagacattgctataaaggagtcgttgttatgaagaaatataaatcagaattaatatttattttcatatttgtgtgtgttcctatagttttagagctagcaggcttcgttaaatttcatttgttatctttaaaaagctgggctatatatggagttttaactgttataatcagcatatttattaaaaggctaaaacacaaccatgggaaaagaggttgtaatgatacagtgtcattaagttaattaaatactaaagaaaccaaagataaaaatgaaatctattttatctttggttttatttgtttgtacacgaggagcattttatagagaattttaatttcttcagcatgaaatttatctagatttgtaatgatacattcatatatatcattagctattttaaattttacagttaattcataaatttaatcagcgataatcatggcatatatatcaatttacaaaatgcatattctcatcttttaatggttcatcctgaataataacatcgttatataagttattttcatttttatacatatttgaattaaataattcaaatagccattgaaaagctttgtgtttaagtttttttctttggtgaagaaaacttgccaagattcgttttaaaatagttataaagttcgtctttgattgatctggcttccataataggatgaattttattaatgttttaaaagggagttttctgtctcttgtaaaattcaatttaaatttgttatctgtaaataataggtttattatcgatggtgacaataggatacatcttttgtttgaaagagtaatgttaaaactttttattgaaaatatcttacatattaaatatgatcagttcacttttttcaatctcaatccaatgaaaaataattatatagtttgatgatcttttattttaaatattaataaagtaaaaaaagattaaaattaatggtttaaatgaataattatagtgattgactaatttgtgcgatatttggtgaaaaatatagatatttcaattgcaatttggttgtgctataattataatgctatagaagtagatgaaaataattctggaggtgtacaatgctaaagagtattagctatgttctaaaagaaaattttactaacttatttagaatatattcgattgcaaaatatgagttgttatcagatatgcgagattctcgattaggggtattttggaacttcgccaatcctgcgatacaaattattacgtattattttgtttttggtgttgttatggatcgtagtgctgtagatgggattccctttattcaatggatgttagcgggaatggtcgtttggttttttattagtccttgtattactcagggtgctaatgcgattttttctaaaataaatgtaattacgaaaatgaagtttccagtgagtgttctaccagctacagttatcttgaaagaattatttaatcatgcgtgtattatgttattgatgattattttctttatgattcaaggaatctatccttctattcattggttgggaataatctattattgttttgcggcatgttgctttggggtaagtttatcaatgataacttctgttttaaatatgattgcaagagatactcggaaacttattctagcttgtatgcgacttattttgtatttgacacctattttatggccgataacacggtttaataaaccagaattgttggatagtttgattcgatttgtcatgaaagtaaatccgatttattatattgtttgtgggtatcgggattgttttttatatcattatgggtttatgcattattggaaacagatgcttgttttttggggcgttacaggaattttatttattataggatgttgtatgatgtataagtttaagcataaatttattgatatgatataggtggtaataatggaagattatgcaattaaatttgaacatgtttcaaaaatatataaattaaaaaagaaaaatgatggtaaaaataaaagtaatgaaacaaagcgtttttatgccctaaaagatattagttttgaaataccccaaggagaagtagttgggatattgggaactaacggttctggtaaatcaacgctctcacttattttggcaggaattagtgaaattgatgaaggaacaatgcatattaatggcgaacagtcattagtagctattaatactggtttaaataaacagttaacgggattggaaaatattaatgttaaaggggcattattaggtttgtctaaaaagcagattcaaaatattattgatggggtcatcgaatttgcagaacttggtgattttttatatcaaccggtaaaaaagtattctagtggaatgaaatcacgattggggttttcgatttcgttgtatttaaatcctgatattataatcgttgatgaggcattatctgtaggcgataaaggttttgcacaaaagtgtcttaagaaaatggatgaattaaaagatgaaggcaaaacgataattttcatctcgcactctttacctcaggtaagaaagttttgtcaaacagccatgtggatcgaaggcgggatgttgcaagaatacggagatgtcgatgaagtctgcgaccattatggtgaatatgttgattattataatggactttctggtaaagaaaaggctaaaatcagagagcataaatttgaaaagagaattgttaaaaatccacagattggtttttgggaaaaagtttttgatcggataaaaggataggtgaagatgatgaagaaggttattacatatggaacatttgatttatttcatgttggacatttgaatcttattaaaagagctaaagcgttgggagattatttgatcgtggcagtaagttcagatgcatttaatgcgcaaaaggggaaaaaagcatatcatagtgatcaagatcgtaaaacgatacttgaagcaatcaaatatgttgacgaagtcatttttgaagaatcatgggatcaaaagatcaaggatgtaaaagaacatgatgttgatatttttgtcatgggcgatgattggaaagggaaatttgattttttaaaagattattgtgaagtagtatatttacctcgtacagaaggtatctcgactacaaaaattaaagacgatctacataattaaatgaagttaagtattataatcccttatgatcgctataaaaattatttacatgattgtttagaaagtattagtcaacaggaaattacagattatgagattttattagttgttaatgatgaaagcgatgttgatgaagagttaaaaaaatacaatataaatatgaaaattattgcagcgggtgctgaatctaatgttgctaaaaaaagaaatctaggaataaaacatgcagctggtgaatatatttattttattgattgtgatgattatttaatgccacatacattatcattattaataaagaaggcaaagcaggatgatttagatctagttgcgggtatccgtaaatttacctggtttaaaaagaaagtttttgaaacgatgggtgatgaaaaaaatgatgaactaaatttaaaagataaagatcatgatcgtgatgataaatttatcaataaagtttatgatgaaagtaatattactgaatataagacagatattttgattagaactcgtcatgcacttagaaatgtttcagttttgaatattttaataaaaacagaattaataaaaaaacatgacattttatttaatgaaaagtttttatattatgctgatgctccatttgtggtgcagttattgaactatgcaacaagttttgctcgagttgatgatgcagtatttgttaaaagaaaacataacgatcctatcaatgctccagcgttgtcacaaatcaaagatcctgataataagtttaatgagtttattgaagctcataattattgtacgatgctagttgaaccagatagctatattcgttattatcttgatgctaagatggtttcttactatacaaagttttttgcgaaaaagattcgtcgcggtaaagatgatgtttggcgtgatgagcgttttaaaatgatgtctgaagtacttaaaaatattcgtcctgaattattgaataagtcatctcgttatagtcgtaaattgatcaatgcagctattaataacgatattgagcgggcaaagaaattagttaatatgcatttagctaaattgaaattaaaaaagataattaaaaacaaaaatgaaatgaacaagtatttgtatcgttatcgttatcttaaagaaccgcttgaagaaaatatgatcatgtttgagacttttatggggaaaagttatgctgattcgccaaaatatatttatgaatatttagctaaaaattatcctggtaaatataagtttgtttgggttttaaatgatcctaaagaaaagccaccttatggagctatcatcgttaaaagatttacacgcaaatatgcctattatttagcaaaatctaaatatttcgtttttaatgtacgccagcctttatggtttagaaaacgtgaagaacagatttttttagaaacctggcatggcacaccgcttaagcgtttagcgtttgatcaagaagaagtaacagcagcatcaccaacatataaagcccagttttatcgtcaaaagcaggaatgggattatttgattgctccaaataaattttctagtgatatttttaaaagctgttttatgtatgatggtaagatgttggaaactggatatccaagaaatgatttgttgtcatcacctgatcgtgagcaaacagctttaaaattaaagaaaaaattaggaattcctttagataaaaaaacgattttatatgctccgacctggcgcgatgatgagtattatggtaatggtaagtataaatttaagttgaaactggatcttgatttattgaaaaaagaattagggaatgaatatgttgtgttattaagaactcatcattatattgccgatgctttagatatcacagggttagaagattttgcttttaatttaagtaaatatgatgatattacggaaatatatttgatcagtgatatttgcattactgattattcgagtgtattttttgactttgctaatttaaaaagaccaatgttgttttatacttatgatctagataaatatcgtgatgttttaagaggtttttatattgatatggaaacagaattaccaggtcctttagtttatacaacaagtgaagttgttgataaaataaaaaatctagataaactaaatgagcagtatcaagagcgttatgaacagttttatcaaagattttgttcgtgggaagatggtcaggcagcaaaacgagttgttgaagaagtttttaaataaggggaataccccttatttttataaggaggctagtgatgaaattaattaagaagtttttaggaaaattaattagatttttatatcgtatagtttatcgctttattccatgtcaaaaagatacaatattatttatttcttttcatggtcgcggttattcagataatccgatggcattacatcaatatataacgaatcatcatgaatatcaaaaataccgttgtatctatgcaatcaaaaaccataaacaaaagaatttaaagattgaaaatgctaagatcattgaatactttagtattccttatttcttttatttagcccgttgtaaatattggatctctaattgcaaattaccaaaatatgtattaaaaaaaccagatcagatctatttacaaacctggcatggaaccccgcttaaaaaattggcgcatgatattgaagtacctgaaggaacaacgttttatcgcagcgggatgtcaattgaagaaatgcgctcaacttatgataatgatgtaagtaaatataattatatgatttcaccaagtagttttactaccgaagtgtttcaaagtgcttttgccatcaataaagaacgcttaattgaaactggttatccgcgtaatgatattttatctaattataatgttttagatattgaccgaatcaagagtaaattgaatttacccaaagataaaaaagttattttatatgctccgacctggcgagacaattcatttaatttaaaagggtatacttttaaattagaagtggattttaaaaaatggcaagaaaatctaggtgatgagtatgttgttgtttttaaaccgcattatttgatcgttaatgattttgatttagatagtgttaaagattttgtgtattttgttgatcctaaagaggatatcagtagtctttatttgattgcagatattttgattacagattattccagtgtttttttcgattatgcaatcttaaaaagaccaatatatttttatatgtatgatttgcaaagttatcgtgatgaattgagaggtttttatcttgatatttatcaagatctgcctggtgaaataattgaaaatgaaaatttattattaaataaaattaaacaaaatgactatgattatgataaattagtaactttcaatcaaagatttaataatcatgaagatggtagtgctagtaagcgtgtattggaaatattgttaaagtaggtggaatcatgggattaaaaaaaataattattaatattattttgagatttgtaaatatatttgtaaatttaagtccaatcaaaaataatcaagtagcttttgtttccttggagtctaataaattagaaagtgatttaaaattaatttatgatgaattaagcaaagatgatcgttataatttaaaaacagtattaattaattataataaaaaaagcctgcttaataattttttatacatgcttaattgtattaaacaaatatatgtaattaatacttcaaaaatagttttgattacagacaataactatgtcattagtaattttaaacgcgaaggcataaaagtaattcagatttggcatgctacaggggcaatcaaaaaatttggtaatgctatcaaacgtgaatatccaatcaaaaattacgattatgttattgctaatagcgattactggaagattccttatcaagaagcttttaatgtattaaaagataatgttattgtaacagggatgccccgggtagatcatttagttaatgatcattatttgcaaagtacaagagttaagttgttacaaaaatatccaattttaaaaaataaaaaaattgttttatatgctcctacttttcgcggaaatatttatcaaggatttaaaagtgtttcttttaatgggaaaaaattgcttgatcaactaggcgatgaatatgttttgatatataaatttcatcctcttttattaaatacagaaattcctagtgatgatagaattatcaatttgagtaatgaagatacccatgatttgtttactgttagtgatatgctggtttcggatttttcttcaattatttttgattatgcatttttaaataaaccgatgtatttttttgttcctgatcttgatgaatatttaaatactttagggtgttttgtggattatgataaaacgatgccgggaccaatatgttttgatgaagaacagttagctttagcgatattaaaagctaaaaaatataatttaaaatattttttacaaacattttttaaatatcaagatggtaataatactaaaagagtagtggaatttattaagaagctttaaaacatcaagaatttcttgatgtttttttgtaaactagtcctttgcctagaaaagaaaaagatatttgaataggttaaagtaggagggatgaacatgtacgaagattacatggataatttatttgatcgccgcccaatgccaatagttgcgcctaaggttggagatatctttttatacactgtaaatcgaggtgataatgtatacgcaattgcaagaaggtttaatactcgagtagattatattaaaaatatgaatgagttagatgatcggatgatgatctatccaggacagcagcttttaataccagtattatttgcaaagataccaccagttaaaccacagccacaaccaagacaatcatatgaactatatttttaaaataactagatttttttaataaaagagtttattatattgttaaatatgtacaaggagaaaaatatgaagttacatgcaggtagtgaacgtaatttaacattggtaatggacttatatgaattaacaatgtcgtataattattttaaacaaggtaataaggatcagtatgtttattttgatatgtattatcgtaaaaatcctgataatggcggatattctatttttgcggggttacaacagttgattgaatgtattgaccacttacattttagtgagggagatattgaatatctccgctcactaaataaatttgatgaagatttttttgattatttaagagattttcattttactggttcaatttatgcagtaaaagagggaacgccagtgtttcctaatgaaccgttgattacagttaaggctaaatttatcgaagcgcagttgattgaaacattattacttgtaacagttaatcatcagtcattgattgcgacaaaggcaaatcgaatcgttaaagaagctaaaggacgcccagtatttgaatttggggctagaagagcacaaggttatgacagtgcaacatatggggcaagagctgcttatattggcggtgttacaggcagtgctactgtatctgctggtttaatgtttaacattcctgtagtagggacgatggctcattcgttcgtacagtcatttgaaagtgaatatgaagcttttaaagcttatgcgcttacttatcctgatgattgtgtattattagtagatacatatgatactttaaaaagtggtgttcctaatgctattaggattgctaaagaggtactagagccattaggtaaaaaactaaaaggaattagacttgatagtggcgatattgcttatttatctaaaagagcgcgaatgatgttagatgtagctgggttagttgaaacgaaaataactgcgtctaattcattagatgagtatttaattcgttcgttattggatcaaggagcacagcttgattcttttggggtcggtgaaaatttgattgtttctaaaaatgctcctgtttttggtggtgtttataaattagtagcaatagaaaaaaataatgagatcattcctaaaatcaaaatatctgaaaataccgaaaaaattactaatccggggtataaaaaagtatatcgtttgtttgaaaatgaaactggcaaagcgattggtgatgtaattgcttttcatgatgaaaaaataacggctgatcaggatctaacgatttatcaccagtctaatatttggaaatttaaaacattagaagctaatagttttagtattgaagagctgcaggtactagtctttgttaatggaaagaaagtgtatccggaatatactgttgatgaaattcgtgagtattcaaatcaacaaaaaagtcgtatttgggatgaggtgtttcgtttagaatatccacatgattattatgtggatctaacaaaaaaattgttggattataagataaagatgcttgaggaaaagagaaagtagttggtgatatatagatggcaagatttgatcgtaaagttgaaagacagaaaagtgaatttaaattttctaaaaaagttgcaccaaaaaagactaaattagatatgtttaaagaaaattttagttttaggtgggtgaaaataaattttagaacaacgatttatttaattattgattttgtttttgtaagtattgtttgtattccatttttaatgcagttttataattcaaaaatggcatttgtgttaggacatggtttgttgacaagtcttttagtagtattgacgttttatttcattggtaaagagaaaccttcaatttttgagttattagttagatattgttttatggcagtagttttaatgataacttcatttattgcgggaatattggtgtaaaatatcatgattattacagttgttggtcttggtgttgtcggtggtagttttgttaaggctttaaaaggtctgggacaccaggtttatggaatcgatattgacgaaaaaactttacaaaaagcaaaagatgaaggttatattattgagggttaccaggatggcaaagatattattttacagacagatttaacgattatttgtttgtatccatcattggttttagattttatcaaaaataacaagtttaaaaaaggcagtattattacagatgctgtaggagttaaatcttattttcttcaagaggcaatgaatattatagatcctgatgttgaatttgtaagtggtcatcctatggcgggaagagaaaaaagaggttttgaatatgctagcaaggaggtattcaaaaatgctaattatattttgattgaacatccggctaataataaagagagtatagtttttatggaagattttgtcgggacattagggtttaaaagcgttaagatcatgtctccgcaggctcatgatgaaattatttcttttacatcacaattacctcatgctattgcagtcgcattgatcaatagtgataatgaaaaatatgatacgggaaaatatattggtgattcttaccgagatttaacgagaattgcaaatattaatgaggatctgtggtcagaattattttttagaaatagtgagaatttattgaattcaatcgtaacttttgaagcgcagttagctttaataaaaaaagcattgctggaaaatgatgagcagttattaaaaaaattatttattgaatcatctcatagaagagagaaattagagaaataacgggttgctactcgttattttttagtctttaagtataatatattaaacaaattgttaaatattgttgcattattactaggattagttataattaaaatgtcgaaaataaaggaggtgtaattatggatattggaagtaagatcaaaaggcttagacaggctaatgggcttacactagaagaattagcaaatcgtagtgaactaaccaaaggatttctttcccagttggaacgtgatctaacatctccgtcagttgcaacattggaagatattttagaagctttgggtactaatttgcaggagttttttagtgaaaaaccagctgaacaaattgcgtttaaaaaggatgatttttttattaatgagcaggatgattatattatttcatatattatcccaaatgctcaaaaaaatgatatggaaccaattttgattgaacttgaaaaaggcaaacagtcgatgacgatcgatcctcatgaaggtcaagagtttggttatgttattcagggaaaaataaaattgataaacggtgataatgaatttatcttgaaaaaaggagagacattttatcttaaaggtttagtatcacattatttgattaattttggtgaaactaaagcgaaggtgatttgggtatcaacaccaccgttattttaaaggagatattatggcaaagttaatagaattagataatttaacaaaagagtataatggacaagttgttttaaagggaattcatcttgatataaatgaaaaagagtttgtaactttattaggtccaagtggttgtggaaaaactactacacttagaattatgggtggttttgaagaggctaatggcggaactgttttatttgatggtcaggatattagtaaactgccgccttataaaagagaattaaacactgtatttcaaaaatatgcattgtttccgcatatggatgttttcgataatattgcttttggtttgaaaatcaaaaaaatggataaagatacaattgaacataaagtaaatcgaattcttgaattagtaggtttggcaggatatggatcaagaaacatcaatcagctttccggtggtcaacagcagcgtgtagcgattgctcgggcattagttaatgagccaaaagtattactgcttgatgagccgcttggagcattggatttaaagttgcgtaaagcgatgcagatcgaattaaaaaacattcaacaggaagttggaattacatttgtttatgtaacgcatgatcaagaagaagctcttacaatgtcagatacgatcgttgttatgaatgaaggacagattcagcaaataggaacacctacagatatttataatgagccggaaaatcgttttgtagcacagtttattggtgaatcgaatattattgaaggtgtttttattaaagattatttagttgaatttgatgggcagcagtttgagtgtgttgataaaggctttgatgaaggacaggaaatagacattgttttaagaccagaggatttagatatcgtagaagttgataaagggaagattgaaggggttgtgacttcaattgtttttaaaggtgttcattatgaaataatggtagaaactaaaaatcgtgattataaagtccatactactgatataagtgaggtggggaaaagagtcaatttagatttttggccagaagatattcatgttatggataaaatgggtagttattaatgaaacattttcgtaaattagttagtccgtattgtttctggttgttttttttaacggttttaccaatgtttttaataatgatttatgcctttgttcaaaaaggaaatacgattacaacatttaattttacactagataacttttcaaagttttttgatcctatttttgtctcagtcttaattaaatcttttgtcttaggaattataacaacagtattgtgtttaataattggctatccagtagcttatgcaatttctaaatgtaaagaaaacacacagacattacttattttattgattacttttccaacttggatcaatatgctgatgcgtacctatgcatggataaatattttaagtagtaaagggatagtcagtaatgtttttcagttttttggttttggggaagtgagccttttatatactgattttgcagttgttttaggaatggtatatgattttttaccatttatgattttaccgattcatacttctcttactaaaatggataagtctttaattgaagcaagtaatgatttgggagctaatccaattacaacattttggaaaattacatttagactttcattaggtggtgttttaacaggcattacaatggtatttttaccagctatttcatcatttgtaattcctaaattacttggtggtggacaatattcgttaattggtaattttattgagcagcaatttattaatgttggagattggcattttggtagtgcggtatctttgattttagcaattttagtaataattctaatggggcttattaatcgtgtggaaaaatatgcaggatatcaggaggaagctaaacgtgaaaaaacaaagaagatttcctagttcactgtggattgtatttgctttagcgtttctttatttaccccttgtaattatggctgttttttctttcaatgattctaagtcattatcaagctggagcggtttttcgttaagatggtatcaagaattatttgtaaatcagcaaatgatcgatgcaattattgtatctgttagtattgcaattttatcaacagttgtttctactgttttaggaacgattacggcaatcggaatttctaaatctaaaccgattcttagaaaaatagttttacaagttaataatctgcctatcatgaatcctgatattgttacagggatttcattgatgctgttgttttcttttgtgaaagtagaaaaaggttatttaacgatgttattagcgcatattgctttctgtacgccgtttgtaattaccaacgttttgcctaaagtaaggcagcttgatgttaatttagctgatgcagcaatggatttaggggcgacaccatttcaagctttgactaaagttattattccgcaaatcaaacctggaattatttctggtgcattattagcttttacaatgtcatttgatgattttattatttcttattttgttagtggtaatggaattgaaaatatttcaattgttatctataacatgtcgaaacgaacaaatcctagtatttatgctctagcaacgataattttggttgtggttttacttgttgtgatgttaggaacgactattcctaaagtttttcctaaagtaactgatagaataatgagcagcaaagttgttaaagtagttttagccggatgcttattattgtcagttggctggtcgatttcaacaggtgttggtaaaaagactttacgagtatataattggggagaatatattgataaaacagttattagtgattttgaaaacgagtatgattgtcgaattatttatgaaacttttgattctaatgagatcatgtatactaaatatatgagtggtaatagttatgatgttatggtaccttctgaatatatgattgaaagaatgataaaagaagatcttttgcaaccaattgataagtcactgatttctaattttgataatattaataaagatattttaggacaatcttttgaccctgataatgattattggattccatatttttgtggtaatgtagggattttgtatgataagacaattgtagataaaaatgatttaaaagaaggctggaacattcttcgtaatccaaaatacaaaggtcaaatttatatgtatgattcagaacgtgatagttttatggtagcattaaaagcattaggttattctatgaacactacagttgaaaaagaaattgatgaggcttatcaatggctgatcgatcaacgtagtgaaatggagccggtatatgttggtgacgaatcgattgatacgatgatcagtggtgttaaagcgatggcaatcatgtattcgggtgatgcaactacagtaatgagtgagaatcctaatatggaatattatttacctgaggaggggactaatgtctggtttgatggatttgttatttctaaggaatgtaagcaaactaagttagctaatcagtttattaattttatgatttctaatgagaattcttataaaaatactgttgaagtaggatatttaacagctaatgtaaatgctgcaaaaaaagcagctgaggaagaatataagggaattagtgcatatcaaattagaacgaatgctaaagatgaagttttttcttatcaggataatgaagtaaaagaaatgtataattcacgctggactaaagttaaagcaaaataatattaaaactgttagtttttctaacagtttttttgttgcaaaaaatattgatttattcatattaattttaattgttgattatgaattagtaaattttttattaaaaatgcttgcaaaattctgctatctggtatattatataaaagcagtccggtgaaagacacggattaaaataaaaaaatggttccatggccaagttggtaaggcaacagactgcaactctgttatcatcggttcgagtccggttggaacctccattatgtgcccaggtggcgaaactggtagacgcacaggacttaaaatcctgcggaccttaaaatccgtgccggttcgattccggccctgggcaccatttctcaaaaaacgacttgcaaaagctagagggatatggtaatatagaaaagcattgtaagaaagaaaaagcgctagtagctcaactggatagagtgcttgactacggatcaagaggttgtgggttcgattcctgcctagcgcgccattaagggaagagagagagcgggaagtagcacagcttggtagtgcacctggtttgggaccagggggtcgcaggttcaaatcctgtcttcccgaccattaaaaaaaattggggccttagctcagctgggagagcacctgccttgcacgcagggggtcagcggttcgatcccgctaggctccaccaagatattaaattatagcattgctgtagttaattacggcggggtagctcagttggctagagcaatcggttcatacccggtgggtcgggggttcgaatcccttccccgctaccagtttaatataaggtacccgtaagagatgaagcaacaaggacccttagctcagttggttagagctatcggctcataaccgatcggtcgttggttcgagtccaacagggtccaccaaataatgcgagggattacccaagtccggctgaagggatcggtcttgaaaaccgacaggggattaacgtcccgcgggggttcgaatccctcatccctcgccatttaattaagaaaagagaatatcgcgggatggagcagtctggtagctcgtcgggctcataacccgaaggtcgttggttcaaatccttctcccgcaaccaagaggtctggtagttcagttggttagaatgccgccctgtcacggcggaggtcgcgggttcgagtcccgtccagaccgccaaatggttccgtagctcagtcggtagagcagaggactgaaaatcctcgtgtcgctggttcgattccggccggaaccaccattagtcagctgtgtagacagtttttttttgactaattttgtgtgtaatcatatatacgtgtttgatattaataagctaaaggagaatgttttatgttgtataagcatcaatatcagttttcaaaaagaatggaaatgatcgatattactaatcagataaaaaaggatttaaaagatgcaaaaatgaaaaatggtatagtaattgtttatacaccacatacaacagccggtattacgattaatgaaaatgctgatccagatgtagttagagatatgttgaatggatttgaacgtgtttttccaactaaccatcctgattatcatcattttgagggtaattcgcatgcccatatgaaatcaacagtattttcgccaagtcaaactttgattattgatcatggacaaattatcttaggagtatggcaaagtgtttatctttgtgaatttgatggtcctcgaaatagaacttattatgttaaatttattgcaggatagattgttaatatatttagagatgattgcagtgtggaaaaatttatagtaaaagtgatttaactattgcaatgactatattacttatgctataatctattcacggcaaaaaaagatttattaaaacaaattttgcgttaatgtaatactgtattttgtttgaaatgtagatatattcttatttatctaagaattatcaaaaaagtcaaaaaacgacttgcaaaagctagagggatatggtaatatagaaaagcattgtaagaaagaaaaagcgctagtagctcaactggatagagtgcttgactacggatcaagaggttgtgggttcgattcctgcctagcgcgccattaagggaagagagagagcgggaagtagcacagcttggtagtgcacctggtttgggaccagggggtcgcaggttcaaatcctgtcttcccgaccattaaaaaaaattggggccttagctcagctgggagagcacctgccttgcacgcagggggtcagcggttcgatcccgctaggctccaccaagatattaaattatagcattgctgtagttaattacggcggggtagctcagttggctagagcaatcggttcatacccggtgggtcgggggttcgaatcccttccccgctaccagtttaatataaggtacccgtaagagatgaagcaacaaggacccttagctcagttggttagagctatcggctcataaccgatcggtcgttggttcgagtccaacagggtccaccaaataatgcgagggattacccaagtccggctgaagggatcggtcttgaaaaccgacaggggattaacgtcccgcgggggttcgaatccctcatccctcgccatttaattaagaaaagagaatatcgcgggatggagcagtctggtagctcgtcgggctcataacccgaaggtcgttggttcaaatccttctcccgcaaccaagaggtctggtagttcagttggttagaatgccgccctgtcacggcggaggtcgcgggttcgagtcccgtccagaccgccaaatggttccgtagctcagtcggtagagcagaggactgaaaatcctcgtgtcgctggttcgattccggccggaaccaccattaaaatttaatgagttgatacataataatgagatatacatattgttgtatttctcatttttttgcttataaagaaaatttactgataaaaagaagttttttgggaataaggataaaagtataaacgaatttttcgctaaatgagatcagatacttgggaattactgtttttagattttaaaggtttaacaagagctaatactaacaggcttttacttaattatttgattgatgatgaagtgaatgtaaatgttttaactgcataagaaaatgaagttgtctcatcgacaacttcatcactaacaattttaattatttcacctgtctacttgacaggggcggttcaaatcaggctactttttcttctagttttctaatcatttgcggacagataatcaaggtagtataagttgtcatcttgattatattttagtaagcggtttttatagaagtgtgccaaaggttaagtccaaaaaaatagattgaaatacataatagagctagtacgtaaattaaggtgtaataggattcaacaataaatagagtaagctatttgatacttatttttatgcgattgctttgtatgtaaatagtgaaaggttgtttttattttataatatgttatactattgtctattaaagaggtgtttagatgaagtataaagagtttcgaatgttgattttttcaattgtttttttctttgtaattgttggtgtatgtatttattttgcactagatcataatcgctcgaaagtaattattggagttattttatcgtttgttgtattaatgatgttaacgactaaatataatatgaaaatattcaatgattctatgttgatttatgaatttaagggaattggaattatgccagcattagttgattataaaaatattaaggatgtaactttaattagtaaacataaagttaaaataaagcatagaggcacttctacactatatattctagatgcggaggccttttatgaagaattgctggaaaatatcaaagaatacaaggatacgattagcagttagtcttatatttttaatgttattatgttatagatatctatttttgaatgattattaaaaagcatgattttaaatagaaaataaataaactgttttgtgttttttatgataatttattagaatcaatatagtttttctttttagattgtaaaagataacgagatagaaaatatatgatttatgaagagagtattatcgagaatacaaatatttagtaatgatttattatttatatatgctttttttcaagataatgatatttttaaagctaagaaaaaattgatttggttgatttccagcatcttctaaagaacttatcgtttctcgaaatcaaagccatgtcaatgttaaaaatatctttttagatatatgatcaaagatgaaaatgattatcctaattcaaatgcatggccatgaaaagaaacgttttcagtttaccagaatgttatatatttagagatgaataaagcgaatggaaacgttgaatctatattatgttcatatgaaagaaattaataattatgtaaaaagaggaactaagtggactgaatagactgtgtagcttgtttataaaaaacagtcatgatgataaaataaaagaccaagcggaagatatcattaaaaacgtgcaatgaattcaagaaagatctataggatttaggaaacgaaagagaattagcactgataagagaagaacagttaaactggagtatgaaaataaccaaaggaatcaaaaaaggtattgggctgggaattatacaaacatgtattaaaatgattaaaaaatatcaatcaagactgccagaacaggcagaaagcttaataggcaaacattagatggaataattgatttttaaagaagattttaaagtttttaagcaaaaaatagatatgattaaataataaggaagaagttttaagatcgtttgttgttaacgaagttaatacttctttttatattttttaggaaaccggaaaaaacttaataagagattgatgtggttgatagatttaaatattacaactaataaatactggcaataatatatattttatgtgaaaattctttttttattattaaaaagaagtaattctcctttttagattgtaaaagataatgaggaggaaaaaatatgattcatgaaaaaactgttatcgataataacaataatgttagctttagtaatgacctgttctttaaatacctgctttccagagatactttagaatctataaaactgagaaagtttatcgttaaatccgttactcatcttgactgccagcagatgatcgttaaaaatcccgaaatcaatcaaaatacggtcctcgctaaaaacatcatccttgatatctgtgccgttgatgaaaagggccgaatcattgatatcgaaatgcagatggctggcaacagtaatagcgaaagtacccgctttcagttctatggtgccagactattagtagaacagattgatactggtgaaaaatatcatcagctaagaccggtatatcaaatcatctttatcaatgaagatgatgatcgtttgatcaaagattatgcgtttcgagatgatcagggagagctggaaaaagaaaatcttaattaccgctattttatcaagatgagacatatcgataagatcatcaaagaaaaaggaatcaaaggattaaatgatctagaaaggttatgttatttgtttataaaaaatgaatatactgctataatgaaggaaagagaagaagatatagtggagatggtgataaagatgtatgacaagtttagaagtaatgagccgatatggtcattagcgaatcagttagcgttagcgaagcttagaactgaatccttagagatggagcgcgaagaaaagacagccaaaaggatcgaagaaggaatcaaacaaggtattgctcaaggagttgagcagggtattgagatcggtaaaatgcgagaaaaaaaggataattgtgtaaaattaattaagaaggtatatagtagagattgtattgagtgggtagaaaatttaactgaagtgcagttagatgagataataaatttgattattgaagaaaatgattttaaaaattttaaacaaaagatagatagattaggataataatttagtactagatgtttatattaacaggatataaaatagtaaaattagttaaaagagcataatagatgaaaagtggttcttactcgaaaatgggcaactaaaaataagagatttcaaaaaataacggtttttattaatcgtttaagaaatctctttctaacataagaaaaaattttctcgttttatgataaatataaaagctgggttataaaaatgtaaattttaaattatctatgattgagtaagagatgatgataaattaattgagttaagattaaatagcttaggtttattaaaaaaactgtcaattctaaatcaacagtttatttgataaattatatttgtttattatgataaccatatgtattttgcatatcgaaaaaagtttttattagattaggaaaataaggaataaatgctccatttttgattatttcaataattttgttttgagaagcccattttactatttggatttcttttttgtagttctaattgacgtaaatcaatatctttaataattaaataaatatcatcaaaaacctgaagaaaattagagaaaaatgaatctaagcatctaattcttcaaaaatttcttttagtttgtttctccttttatagcactttcacctatgctaatattccattttataatttcatcaattatataagattataaaagcgttaatcataagaccaacgcttttatttattaatagattccttgagaaatcattgctgctacgactttttcaaatcccgcaatatttgctcccttaattaaatcataacctaaaccatatttttcagctgcagctacagaagaattatgaatatcaatcataatattatgaagtttttcatcaacttctttagctgtccagttataacgcatagagttttgagacatttctaatgcagaaacggcaaccccaccagcattagcagctttagcaggtcctaaagttccaccattagctaagaaataatgaacaccttcaggagtagttggcatattagctccttcaataatatatttaactccattagcgattaattgcttagcctcttcttcaccaatttcattttgagtagcacaagggaaagccatatctacttttaatccccatggtttttcacctggatggaattcacaaccaaatttttcggcataatcttttaatttgacatcattagattcacgaatcttacataagaaatcaattttttcatctgttgtaattccttcaggatcatatacatatccatcacgtccagaaatagatactactttagctccatattctctagcttttaaacaaactccccaagctacatttccgtatcctgaacatgcaatagtcttaccttcatagctgtcattaaaatgagctaaaacttctttaccatagtatacagctccaaatccagttgcttctggtctaatcaaacttcccccataaggtaatggtttaccagttaaaacaccattttcataagcacctctaatacgtttgtattgaccatataaataaccaatttcacgagcaccagtaccaatatcccctgcaggtacatcaacatcaggtccaatatgacgatatagttcagtcatgaaactttggcagaaacgcataatttcgttatcagatttcccttgtggatcaaaatcagatcctcctttaccaccaccgataggtaaagtagttaatgaatttttaaagatttgttcaaatcctaaaaatttaataattcctaagttaacgcttgggtgtaatcttaaaccacctttgtatggtccgattgcacttgaaaattgaactctgtatccacggttaacttgtacttgaccattatcatccatccatggtactttaaacattaaagttcgttctggttcaactaatctttctaagattgcttgtttttcgtattctggatgagcttcgataactggttttaagctctctaatacttcttcaactgcttgaataaactcaggttgatcagcgtttttttcttttacttgatttaatactttagtaatgtaatccatttgtatattcctccttgttacaaataatataatactattaatctaataataaataaattttttaagaaaaatatattataaataaaaatatttgttatttttatttaaaaaataccatatttatacattagaattctatgtaaagaattaatattaaaatgatttatagaaagcataaaaaaagatattatctcaatcaaaaatgcaacattttatccatgtagtttaagatttgttgaagaaaacaacaaattcatcaaacattttatatagaagaaacaaaatagtcaatcattttagaagaatcgaactataatcaaagtatttttaaattagtaattgtttttttggaaactggattacatgaaatttaaacaatagtaaaaagaatatctaaaagtgataattttatcttttcatttgttaaaagatatggtatattgtatacaatgagaggtgtttaatatgaatataaaagcaaacttacaattacatcaccatcattggattgcctagggttttatcgactaatgatacaacccattttgtgttaaatattaattgggtgtatctaatgacaatattactttagcgagtcattagtaaatgactcgtttttttataactaaagggggaaataaaatggaagaatttaagtatttaataccagaagaaagtattgatgcaattattactaatgtatcggaattaagaaaaattgaaaatagtttgcgaaatatctttgctaaaaatcattatagcgaagtattgatgccatcttttgaatatgtagatctatatactcaattagattgtggttttgaacaagaaaagatgttccaatatattaatcatgaaggtaaaaatgtggccatgcgctgtgattttacgattccactagcacgtttttattcaacgaataattatgatgaaaaagaagcacgttattgttattttggaaaagtttatcgtaaagaaacgatgcataaaggacgttctagtgagttttttcaaggtggagttgaattgatcaataaaccggggcttgctggagataaggaatgtttaagtatgattcaggaatctttaccacatttaggattaaaaaatattttagtagaaatcggttcggctcagtttttcaatcgtttatgtacgcttgttggcaatagagcagcagaattaacagaaatattaaaatttagagatattagtagaatgaaaagatttgttgctgataatgattttgatcaagacttaaatgctttattattaaaacttccaacagcgtttggggatattaaattattagatacagcaattgaaagcattaatgatcaagtaatgttgaaggcattagaacagttaaaagagctatataattcattagataatcaagaaagtattatttttgatttagggatggttccaacgatgaaatattatacaggtttaatgataaaaggatatagcgataaaagcgctcagccaattatttcagggggaagatatgatgatttattgccaagatttaataaagatgttggagcgattggtttttgttatcatatgaatcatattttaaaagcacttgataaacagggggaagatgataatgattaaaatagcgattactaaagggagaattgaaaaacaagtttgtaaattattggaaaaagcgggctttgatatggaaccaatttttaataaagatcgtgagctgctgattgcaactaaagacggtattgagatgatttttggtaaagctaatgatgtagttacttttttagaacatggaattgttgatgtaggttttgttggtaaagatacgcttgatgatgttgattttgaagattattacgaattattagatctaaatattggtaagtgttattttgccgtagcagcatatcctgaatatcgtaataagaagtttgtacgtagaaagaagattgccagtaaatatacgaaagttgctaaaagctactttgcaaaaaagcaggaagatgtggaaattattaaattagaaggttctgttgaattaggaccagtgacgggaattagtgatgcgatcgttgatattgtagaaacgggttcaactttgaaagctaacggtttggaagtaattgaaaaaatcagtgatatttcaacgcgattgattgttaataaagtaagttttaaatttaaaaaagatgaaattatgaatttagttactaaattagaaacagttacggaggataaaaaatgttaaagataattgattataaaggtaatttagaagcagtagccgctaagttagatagccgtaaagaaagtgttaataaagaagtaaatgatatcgtattaaaaattattgaagatattaatatgcgtggtgatgaagcactgtatgaatattgtttaaaatttgatggttataaaattacagatgaaagtgatttgatcgtaagtgaggctgaaaaagaagaagctttaaaacaaatagacgctaattatatgcggatcttagagcgaacaaaaaatcaaatcattgaatttcataaaaatcaaattgataaatcatggtctttatataaagataatggagtaattatgggacagatggttcgtccaattgaaagagtagctttgtatgtgccagggggaacagctagctatccttcaactgtattaatgaatgccttaccagctaaactagccggtgttaaagatctagtaattattacaccggttaaagaagatggcaaagtaaatccaataattgttgcagcagctaaagtcagtggtgttgatacgatttacaaatttggcggagctcagggggtcgtagcgatcgctcatggaacgcagacaataaaaaaagttgataagatcgttggtccaggaaatatttttgtcgcaactgctaagaagttaagttatggtttagttgatattgatatggtagcgggacctagtgaagttttagttattgctgatgaaaacgctaatcctaaatatattgctgccgatttaatgagtcaggctgaacatgataaattagctagtgccttgcttgttaccacaagcagagagttagtagctaaggtaaatgatgaattaaaacgacaaattacatatttatcaagaaaagagatcattgaagaatcattgactaattatggcggtgctattatcgttaataacttagatgaggcctttacagtttctaattatttagcaccagagcatttagaagtcttagttgctgatccgattaatacactaccaaagataaaaaatgctggttcgatctttttaggtgaatattcaccagaaccgttaggggactatatgagtggaactaatcacgttttaccaacgggtggaactgctaaattttattcggctcttggggtatatgattttgttaaatattcatcttatagctattatcctaaaaatgttttaggtgattttaaagatgatgttattgaatttgctaaaagcgagggattagacggacatgctaattcaattgcagtaagatttgaggaggaatagttgtgcgaattggtaaaatagagcgagaaacaaaggaaacaaaaattttagttcagttagatttagatggtgaaggtaaaagtgaaataaataccggaattggcttttttgatcatatgttaacattattagcttttcatggtaactttgacttgatcgtgaaatgtgatggtgatcttgaggtagatacccatcatacaattgaagatctaggaattgctttaggaacttgtttaaaagaagcgttaggtgataaattaggaattactcgttatggggcttttacgattcctatggatgaaacacttgtgacaactaatctggatattagtggtcgaccatttctcgtttttaatgtaaatctaacttgtgaaagagttggtacttttgaaacagagatggcagaagagttttttagagcttttgcttttaattcattgattactttacatattaatgaacattatggtatcaataatcatcatattattgaagctgtatttaaaagcctaggtcgcgctttaaaacaagctgttagtattgatgaaaataataaaaataaagtagtctcatcaaaaggagtactgtaaggaggaatattaatggtagttatcattgattataatattggtaatttaagcagtgttacctcagctttaaaaagaattggcgttgaagcaatcgtttcccgtgataaagagatcattaaagaagcaaaagcaatcgttttacctggggttggtacttttcctgtagccatgaataatttaaagaaatatgatttgattgatgtgttaaatgaatgtaaggataaaggaacaccaatattaggaatttgtttaggaatgcagatattgttcgaaaaaggttatgaagtagaggaaactaaaggattaggttttttaaatggtgaagtagaatttatggatattgatgaaaaagttcctcacatgggctggaatcaattacattttaatcaagaacacctgatcttaaagaatattcatgaaaatgatgatgtttattttgttcattcatatatggcaaaatgtcccgatgaacagttgatcgcatatagtgattatggtgatacaaaagtaacggctctggtggctaaagataatgttattggctgccagtttcatccggaaaaaagcggtactgtagggaaacaaatattattagcgtttaaggagatgatcgaatgttaattattccagcaatagatttaaaagatggccaagcagtaagactgtttaaaggggattatcaacaaaaaacagtttacagcaataaacctgaagatttagctaaagcatttgaaaagatgggtgcaaaattgcttcatgttgttgatctagatggggctaaagatggtaaatgtgttaatcttgaaacaattagaaaaataaaacaaaatacctcaatgcaagtagaacttggcgggggaatcagaaatatggaaacagttgctttatatttagatgaggtagggatcgatcgcgtaattttaggaacagcagctatcaatgatcctgattttcttaaaagagcattggctgtatatggaccagataaaattgttgttggagttgatgttaaaagcggttatgtttcaacttcaggctggttagaaacgagcaatgtgccatatttagattttattaaagaattagaaaaattaggtgttaaatatatcgttgcaactgatattagtaaagatggaactttacaaggaccgaattttgaaatgtatgaaatgattgcgaaaacttcaacgattaattttgttgtttcaggcggaatcaaagatgttcaaaatattaaagatgcagctagtaaaaattattatgcctgcattgttggtaaagcttattacgaaggtaaagttgatttaaaggaggttatttcatgcttacaaaacgaataattccttgtttagatattaaaaatggtaaggtagtaaaaggaatcaattttgtgggattaaaagatgttggcgatcccatcgaattagctaaacgttatgatgaacagtgtgctgatgaagtcgtgtttttggatattacagcaagttatgaacagcgcgatattatcaaagacttgattgaacgtggcgcaagtgagttatcaattcctttagcagttggtggcggaatcaggagtcttgaagattttagaacgatcttagcttgtggtgctgataaggtatctgttaattcagcggctatcgctgatcctaatttaattaaagaggctgctgatgaatttggggttcagtgcgtggtcgtggctattgatgctaaaaagcgagataatggcggttatgatgtctatattaaagggggacgtgaaaatacgggaattgatttaattgaatgggtaactagatgtgaaaagttaggagctggagaaattcttttaacttcaatggatgctgatggaactaaagctggttatgatattgatatgatcaatgctgtatgtgatgctgtcgatattcctgttattgctagtggcggttgcggtagtattcaagatattgttgatgtttttaaaaagactaactgtgatgcagcattagtggcttcactgttccattttggtgaagccacagtcgaagatgttcgcgttgaattaagaaaacatggtataaacgtaaggagagcaatgtaatgaaaccagattttaaaaagatggcgttaattcctgcgattgttcaggattataaaacgaatgaagtattgatgttagcttatgttaatgaagaggcatatcaaaggatgctggaaacgaagcagacttgtttctattctcgtagtcgtaatgagttatggcataaaggagatacttcgggacattttcaaaatattaaaggaatgtatttagattgtgatcttgatacattattgatctatgttgaacagattggagctgcttgtcatacgggggcatattcttgcttttttaacgaaataatgccgtatgataatactaatatttttagaagtttagaaaccttgatagaagaccgtaaattaaatccggttgaaaaatcttatactaattatttattagatcaaggtgttgataagatttgtaaaaaagttggtgaggaagctagtgaaacgatcattgctgccaaaaatacaaataaagatgaattagtaggagaaattagtgatttgttttatcatgtttttgtattaatgaacaatcagggtgttagtcttgatgatattgaaaacaagttaaaagcacgtcataaaattacaggaaacaaaaaggattttcatactagaggtgattattgatccctctttttctataatatttaaaaataaaggagaattttatgagagcaattgattatcatatgcatacctgcttttctggggatagtgaagcagaccctagagagcatgtaaaacaggctattttaatggggttagatgaaatttgttttactgatcatcgggattttgattatcccattgattcttttgatttagatgttgaaaaatattatcaaacgatcatggctctaaaagaagagtttaaagatgaaattaaaataaaatggggtattgaaattggtttagatatgaattatcaaaaagagatcaacgagttgatcaatcgctatccttttgatttcgtgattggttcaattcatgttatcgatcatactgaattttattatggtgatttttttaaaggattgtcaaaagaacaggcgcatcgttatttttttgaagaaacgttgaggtgtgttaagaattttgattgttttaacgttttaggacatttagattatattatgcgttatggtccctatgaaaataaaatgatcgatcatgataaatatcaagatcttattgatgagatatttaaaacgttaatagcaaaaaataaaggaatcgaggtaaatacatcaggttatgctttattaaaaacgtgtggatttcctaattttgaacaagttaagcgttattatgatttaggtggacgaattattacgatcggaactgatagtcatacaagtgatcgcgttggtgaacatgttgaagatgttaaaataaatttagaaaaaattgggtttaaagatgtaactacttttactaatagaaaatgtgattaaaatgttggaaagaactatttatattttttttgatgttgatggtgttttaaataatcatcaagctcgaaagaaatatcagggtcgtgagatgagaataatttgtgatgataacttgttacaatttgttgagctgataaataaaattgaagataagtatttaattgtgttaacttctacctggcgttattcccctgatagtataaatatcttaaaaaaagcattaaataagtataatttaaaattatctaattgtttagatattgcacaatctaaaacgcgaggaaaaataattatggaatattgtcaacaaagaaatattttatatgatgatatcataattattgatgatagtgatattgttgaactaccagagcggttaattaagtgtgattataactgcggtttaacaaataatgaagtaaaaaaagctttaatgcttttaaaataaatatttaagtggttaatattatactttttataattagtaaagttgattttataaagatagcagtataaaagtttattattaatgatcgtaataagaagataatttattaattaaaattttatttatagattatcataggtaagtattatttttaatggtttgttgtatcaaaaaagcaatgttcagtatttaactgatgcattgctttttcagtaaattaatttatcaagtttaaataaatatttattataaactttcttttaaaatattaacaatttcttcacgatcaaggattttataaccacctggcataatagctgtaacatctgcaatatcctctatcatatctttgtttgcaccaagttctgtgatattcattacaagtccaagttctttcatccaattttccattgcttttaggccttctaaagcaatttcttctttattcttttcatctgttttaatatcccaaacatttgttgcaaatcttacaaacttatctaaaccataaggcataatatatttataataaggaagtgaaactgctgctaaagtcattccatgtgtagcatttgtatagccgccaacagcttgtcctaacatatgtaccatccagtcggttgatttgcctttagcaatcaaagtatttagtgcccatgttgcaatccacataatattacttcttgcttcataattgttcggatctttaatagcaatgcgacttgagtgaatgagtgacttcattaagccctcgctaatataatcactggtattatcatctgttccagaaaaatattgttcacaaatatggttgaaaatatcataaataccagaaaccatttgatagtatggtaaagataatgtgtattttggattaagaatagagaattttggcataatagcctcatctgcaaaaacgtgtccaattttttgctttgtttgttgattagttataacagcacctgaattcatttctgatcctgttccagccattgttaaaatgcagccaaccggaattatttcacagtcaggttcttcaaaacgtaaataatatttttcccatggatcttctgtacaatttactgatacggaaacagcttttgcataatcacacactgagccgccacctacagctaaaagtaaatcggcatgatgatttcttgcgatttcgataccctcgtataatttttttagagtgggatttggcataactccagaaatttcaacaatattttttttgttttttttcaatatttctataactgcatcgtagataccattttttttcacggaaccaccaccataaattaatacgatattgttgccatattttagaagttctgtatttaaataatctaaagagttttcaccaaaataaagttttgttggattacagtatgaaaaatttccaaacataatttaatttcctcctatttatcattaattttaagcagaatatttgacatttatgttctactctgataaaattttaacacctaaacctaactttaggtcaatattaaaataaaaaattattcaaggggtgataattatgtatactataggacaagtttcaaaaaagtttggtttgcctatttctacattacgatactatgataaagaaggcctatttccaaatatgcaacgaatttctggaattagaaaatttgatgaaaaggaaattgaagctatacggataattgaatgtttaaaaaaatcaggtatggaaattaaagatattaaactttttatggaattatgtgtacaaggaagtgaaacttatttacagcgtaaggaattatttttaaagcaaaaagaaattttggaagcagaaataaaacgaatgaatcaagctcttgatatgattatatttaaatgctggtattatgatcaggcaattaaagatggtaatgaagatcgtgtttcttcgatgaggccagaagatatgccagagttaattcaacaggcttatgaaaatgctcatcaataaaaatattggggaatttgagttggtcattaattttgaaggattgattaaaatgaacttgatttttgaagagatagaatgattataattgataataatttacaagctataaaaagcaggtgcttttaattagtataaatagataatattttagataaattttgtttttttatagagtaaaatatctcctggtttaattaagatttaagttctttttattaaatgaaataagttgttttttcgataaaaagagctattaaaataggtttatgaagataaaattttgtttttaatttgtatggttttaatttatatataaaatttaaaaagatttgagatattattattgagtttatgatataatgggtagtatacatttggaggtatagatatggaattatatagtaaagaattattaaaaaagttaaaagatacaattagtgatgatggttattatatgccaaaaatattatttaatagtaataaatatgtaaatattcgtttagaaacaaagcttgcttatgtagctttgttggatactttattaaaaaaacctgtttttaatcaaagtaatttggctttattgaaagctgataatcctgtaatagggaagacattagctattttggctaataaagaagttgatcaggaaaaggttaataagtatttaaatgaattaagtgaagctaatttaattgaaattaataaacaagatatttatatatatcatttagattaaaatgtttaaaattttagcaaaaaagttcattaagaactatacagattataaaagttccaaagtaagagagcaatatggaacgctttgttcgattatttcgattggatgcaatattgttttagttatctttaaacttacaatgggagttattacaaatagtattgcaatccaggcagatggattgaacaatttatctgatgttggtagtaatttagcttcattatttggctttaaattagctaataagcatcctgattcggaacatccttatggtcatggacgaatggaatatgttgctggtttaattattgcttttttaattttattagttggttttcaggctttaaaagattcaattttaaaaataattgctccgcaaaaagtaacttttacagtagttgcagtaattattttggttgtttcgattttaattaaactttggatggcatcatttaatcgttatgcttcaaaaaagataaattcagcaacattattagcagctagtcaggatagtttaaatgatgtattagcaactacggcaactttatgttccttgattttatctttatatacagatttacctgttgatggaataatgggaacgattgtttctattattgtgttaaaagcaggaattgaaatatttaaagatactgtgaatccgttattaggcatggcaccagataaggaattgatcaaagatattgaacagtatattttatcatttcctgaagctttaggaattcatgatttgatgatgcatgattatggtccaggtagaagatttttatcattacatgttgaagttgatcgtaatgatgatattatggcagctcacgatgctatcgatattattgaacgagcagttttggataaatatcatattctaacgacgattcatatggatcctgttgatttcaatgatactttaactaatgaattaagaaaaacggttataaaaatagttaaagaaattaataatgaatatagtattcatgattttcgaattgtttcagggacaacgcacactaatttgatttttgatgttttgattccttcaaatgatcaaatagagcataagattttaaaagaacagataaatagaaaaattaaagctattgattcaagctactatacaataattcagatcgaacatagttatgtataagaaaagacttaaaattatgaaaataattttaagtctttattaattatgctctaaatattacttcttctttttcatacatcatcttagcaccgatcattgaaactattacataaacaacagaccagccaatcgtcatatatagatgagtataatttaattgattaaagataatttctttaataacaataactacatttaaaattggaatattcatcatcgcagtagaaacagaacttggttccatgtacattgtaactactgaaagaagcacgggaatcaaagttactggagtcaaataagtgtttgcttcttttaatgaacgagcataagttgatactaaaagcattactgcggaaataaaaactacgtataaaacagccaataaaataatcaacagcatgctttgaattgataaatcgatcgtaatagccatagtatcactcattccaaatttaaatgcaaggagtaaaccaacagcagataaaatagatgtaatagttccaaatgttgcggtaacgagcagtttaccaatcaaaatagaacttcttgagatgctagttgaaagtaatggttctaaagtaccacgttctttttcaccagcacctaagtctgtagcaatcggaacgatcccagaaccagaatagccgatgatcatcatgggaatcaacattcctaacatcattaatgataggctgtcaacatcatcatctttagcatgttcattgtaagtaaagggctggagaatattactagagagattgttggcttctaaatatgaagctaaataactgttttgataactgctaaagatattttgaacggtactaatagcagttaaagcacgttgtgaagtagtatcgtaatacagatcaacttcaggagtcgtaccttcaattagcgatttattaatatttttagctatgatataagcagtaattttaccatcataagcatcattaataggatcattactatttaacaattcataaataccggcttctttgaaaattgctgtaatttcaggatcatttgtatctaaaacaattttatatttattatcttcactaggagttgccatgtcgctgactgatgaaaagataaaagtaaatagtaatggcataataataataggaataacaaatgtcattaataatgttttacgatcccttaaaatatctttaaactctttttttacgatcgtcatgatattattcattgctttcacctccgatacattcgataaatagttcttcaagattatctttttgataatctttttttaattgatcgattgtaccactggcaacgatcttacctttatgaataataataatacgatcacaaagtttctctgtttcatacatattatgactagaaaaaacgatagctttattttcctttttacattttaaaataaaatcatgaataagtttactagacataacatcaagtcctgtagttggttcatcaaacaacatgacatcgggatgatgaataatgctgcgtgctaatgaaactttttgtttcatgccgcgactgtatttaccaacagggcgatctatataatcgaccatttctaaatcgcgggatatctgatcaacagcatttgcagcttcttcatcactcatcccatttaatttagcaaaataggtcatgttttctcttcccgttaaacgatcatatagagctacgtcaccaccaaatagaatcccaattttttctctgattttatttggattgtcaattatgttgtcttcatcaataaacgcatttccgctagtaggtttaagcatcgtggcaatcatccgtaaagttgttgttttcccagcgccattttccccaagcagaccaataatttctccttgatcaacttcaaaagaaacattttcaacagcgttaatttttctaaatgttttagttaaattctcaacttttaacattctatttcctcccttttaataagcaatacaatgatttaaattaaagaaaagcttaatatcttttattgcaatagatatataatcccatacgtatcattgctattacaaaaatacataatgtaatcccaattaataaatcaaaactgtaaagaggagcaactattgaaagtaatgctagtataattatttcaatcgtaaaactaaaattactaccaattttatcagcaataaataattttcgttcatcatgatcattaatatatttattaattaatcttgtttcatttttggcaataaaatgattagaaatcaaattgatgcatggtaaaacaagcaaagtaaaagatagaccagtttgatagccacgcacataatcaatatgtggttcattcactaaatttaccgttaagatacctgtaaaagataatccagttaatatcaaggatgtaattattagagcaatcatccaataattatttttccttaaatctttacgggctaagacaatttgattattcatttttaagttcctcctcaaaacaaaatacatcttcaattgtcaaatcaaaatatttggcaattttatatgctaatagtaaagaagcagtatatttgcctacctcaattgaggtaattgtctgtcgggttaccccgacagaccttgctagttcctcctgggatattttacgtgcttttctaagctcaggaattctagttttcattatatcactccattttgcaaagttcactttacaattatagtatagtaagctttgcaatatttgtcaaggatactttgcaaaagtaaaatatctcaatctttaattggatatttttgacaatttttaattaacttttgttcaattatttcttcaatatcaagatttaatgaatgcgctaactgaaagcaataaatcatcacatcagcaagttcctcactgacttgatttatatcataattattatcccattgaatacattcaagtaattcactagcttcaataacgatacttttgattaagctatcaggataatttaattgatcccaatttctcttttgtacaaattcaataattttattttctaattctttcattatattctccatctactttttgtttaaacactgcaaaatcatcttcttcaaaaatcaattcaattattttttctaattgcttttcactcaagccttctacccattcctgacagtcttgatgatactgttttttgatcattttaatacatgtttgttcgataccctgtttgattccctcttcaatccttttggctgtcttttcttcacgctccatctctaaggattcagttctaagcttcgctaacgctaactggttcgctaatgaccatatcggctcattacttctaaacttgtcatacatctttatcaccatctccactatatcttcttctctttccttcattatagcagtgtattcattttttataaacaaataacataatctttctagatcatttaatcctgcgactcctttttctttgatgatcttatcgatatgtctcatcttgataaaatagcggtaattaagattttcttttttcagctctccctgatcatctcgaaacgcataatctttgatcaaacgatcatcttcattgataaagatgatttgatatactggtcttagctgatgatatttttcaccggtatcgatctgttctactaacagtctggtcccatagaactgaaagcgggtgctttcgctattactgttgccggccatctgcatttcgatatcaatgattcgacccttttcatcaacggcacagatatcgaggatgatatttttagcgaggaccgtattttgattgatttcgggatttttaacgatcatctgttgacagtcaagatgggtgacagatttaacgataaactttctcagttttatagattctaaagtatctctggaaagcagatatttaaagaacaggtcattattaaagcgaacattattgttattatcgataacagttttttcatgaatcatattttttcctcctcattatcttttacaatctaaaaaggagaattactttaaaaaattaaaaatattcaaataaaaatataaacagacaaaactgcttaatgttttgtctgtttattatttatttactactaatatttatcagcttctatcctttgtttaaatacttcaaaatcatcttcttcaaatatatattcatatattaattctatttgcttttcacttaagctttctacccatttatggcagtcttgatgatattgttttttgatcattttaatacatgtttgtttaagagcttctttttttcctatttcaactcctttttctcgtccaatctcaataccctgctcaactccttcttctcgtccaatctcaatcccttgttcgataccttttttgattccttcttcgatccttttggctgtcttttcttcacgctccatctctaaggattcagttctaagcttcgctaacgctaactggttcgctaatgaccatatcggctcattgcttctaaacttgtcatacatctttatcaccatctccactatatcttcttctctttccttcattatagcagtgtattcattttttataaacaaataacataatctttctagatcatttaatcctgcgattcctttttctttgatgatcttatcgatatgtctcatcttgataaaatagcggtagttgagattttctttttccagctctccctgatcatctcgaaacgcataatctttgatcaaacgatcatcatcttcattgataaagatgatttgatatactggtcttagctgatgatatttttcaccggtatcaatctgttctactagcagtctggcaccatagaactgaaagcgggtactttcgctattactgttgccggccatctgcatctcgatatcaatgattcggcccttttcatcaacggcacagatatcgaggatgatatttttagcggggaccgtattttgattgatttcaggatttttaacgatcatttgttggcagtcaagatgagtgacagatttaacgatgaactttctcagttttatagattctaaagtgtccctggaaagcagatatttaaagaacagatcattactaaagctaacattattgttattatcgataatagttttttcatgaatcatattttttcctcctcattatcttttacaatctaaaaaggagaattactttaaaaaattaaaaaaaatctataattaatgaacatattaaaaatagacttgacatttaaaacatagttagttaatatgattataacgacagtgaaaagaagagtagtttatttaagcttgatagagagtccttggctggtggaaaaggataggtgagagtagatgaagatggtcttggagtcttataggcgatatttagtctatgacgggtgtgcccgttaaagcactagagtatgatagtacttgaagaggttattatcgtgagataataatgaattaaggtggtaacacgggttataactcgtcctttgtaagggcgggtttttatattttaaaggaggattttatgattgaaattaagcaggttagtaagaaatatcgattaaaagatcatgaagtagtagcagttgatgatgtatcattaaagattaatgatggagatatttatggaataattggttatagcggtgcaggtaaatcaactttagtgcgcttgatcaatcagttagaagttcaggataagggaaagatttttattgataatcaagatttaggtagtttatctcaaagtggacttagaaaattacgaactaaaataggaatgatatttcaacacttcaacttgttatggtcaagaactgttagtcagaatattgaattggctctagaaattgcaggcaataaagataagcagctacgtcataaaaaggttcaggaattagtaaaactggtgggattaacgggcagagaaaatgcttatccaagtgagttgtcaggtggtcaaaagcaaagagtggcaattgctcgagcgttggctaatgatccaaaaatacttttatgtgatgaagcaactagtgctttagatcctgatactacaaagtcgatcttagatttgttattagaaataaatcgtaaattaaatattacgattatcttaattacgcatcaaatggaagttgttcaaaaaatctgtaatcatgtagctgtaatgtctgaaggaaagatcgttgaaaaaggaaaggtcaaagagatttttactgctcctaaacatgcggttactaaaagttttattcaagaggtaaaaagtcataatgaatttgatgagaatgttttgaaacagatatatccacaagggcaattgattaaagttgtttttgatgaaaatgttagtcgtttaccaattttaacaagagttattagagagtgtgaggctgatcttaatgtaattgaagcaaatttaagtaatacgatcgatagttcttttggaatcatgattttacaagtaatcggggattatcaagaagtaatcagcttatttgaaaaatatttagctaaagcggaggtgatgtaggtgagtgctattttagaaaatatcaatcttgatgttatgatcaatgctttacaggaaacactttttatgacctttgtttcattgatatttgcagtaattattggaatggttttaggaattttaatatatttaacgcaggaagatggcttatatcctaatcttgtcgttaataaaatcttaaatttcattgttaatgttttacgggcagtaccatatattattttattgattttaataataccgttaacaacagcattagtgggatcgatgatcggagctaaagcagcattaccatcattaattttatcaagtgcgccattttatggaagaatggtaatgattgcattaaatgaagttgatagtggtactattgaagcaagtaaggccatgggtgctagcaattggcaaattattattaaagtattgattcctgaagcaaaaccagctttgatttcatcgattacagtcatgggaatttcattagttggttatactgcaatggcaggtgctattggggcaggaggacttggaaatttagcatatttgtatgggatggttagaagtaataattatgtcatgtatacagcaacgattttaattttaattattgtgtttattatccagtttattggagattactatgttagaaaaatagataaaaggtaggtaagaaagatgaaaaagttatttgtaggaattatttgtttattattagtagttgggttaacagcatgtggtaatagtagtgaaagtgatgaaaaaacattgacggtggcagcaacttcaaaaccacatggagatatcttagaagaagctaaatcgattttaaaagatgaatatgatattgatttaaaaatcgagatcttagatgattattatatttttaatcgctcattgaataatggagatgttgatgctaactttttccagcatgttccattttttgaaaaagatgttaaagataatggttatgatttggtaaatgttggtggtgttcatattgaaccatttggtttttattcaaaacaaatcaaggatattagtgaattaaaagaaaatgatgttattgttatctcaaattctgttgcagatcatggacgaattcttgcaatcttggataaagctggtgtaattgaattagatgatgatgtaaaggttcaagatgctacaattgaagatattaaatctaatccattaaatttagagtttaaagaaattaaaccagaaattttaacaaatgcttatgaaaataatgaaggtgctttaattgctattaatggtaactatgctattgatgctggtttaaatccaactaaagatgcggtgcttttagaatcagcagatgaagataatccatatgtcaatattgtagcttgtcaaaaaggacatgaaaatgatgaaaagatcaaagctttgatcgaagttttacaatctgataaaattaagaactatattactagtacatatagtgatggatcagttattcctgttaaatagatgcgaaagcatcttttttaataatagaattatatgtataattagattaaggaggataaaaatggcgagagttgaatcagcagattatttaaataaggaagtagaagtaataattgatcgtaagttagggtcaagacatccaaaatatggatttatgtacttacttaattatggatatataccagatacacttagtggtgatggtgaagagttagatgcatatttattaggtgtatttgaaccagtagagaaattttggggtaaagtaattgcaataataaaacgaactaatgatgatgacgataaattgatcgttgtgcctaatgatacaacttatagtgatgaacagattagagctttaacagagtttcaagaaagattttttacatcaatgatcataagaggtaataacattgattaaaacagtagatgactataatagtaaatttaataatgatattaaaaagaaattagattgtttaagaatgatcattaaacaaaatgctcctgatgctaatgaaaagatatcatggggagtaccaacatataatttaaatggttttttagtgcagtatgcagcatgtaaaaaacatattggtttttatacttctttaacaacacttgaatattttaaagagcagttgaaagactataagacaaatatgaaaaatacagttcaatttccaattgataaagaattgccagttgatttgattaaagaaatggttttatttaaggttaaggaaaataatagagattaaaattttagatattatgagattagtttatcgttttaaagatattgaaaagcagttgattatttaccagaaaagagatgctgatagttattttaactgtttatcaaaaatcaaccagctatagatttttatttaaaattataataaatagaaaatattaaaacgatagaattaatgatggagtataataatgaaagattatcatagaaaaaatcatgaattttctttatgtggtttagcgtgtaatttatgtgtaatgtatctaggtagatattgtcctggctgtgggaatgaaaatcagagttgtcgtttaaaaagatgtgcaattgaacatggaaaattagagttttgtaatcagtgtcatgagtttccatgttatgaatatgagggtagagatgaatatgattcgtttattacaattagaaatcgatataaagattttgagcaattaagtgaactaggggaaactgtttttattgcaaggttaaagcaaaaagctaatattttaaagtatttattagataattataatgatggaagaaaaaagacgttttattgtttagctgtgaatttgcttgacttaaaggatttacaaatagttatggaacagatcgatgaagtgattttagagagtgattctcttaaaataaaagcagctaaatgtgttgattgttttaatgaaatggcaaaacagagaaatattgttttaaagttgaataaaaagaaaaaggagaaaaagtaaatgcgtctaggtacaacttatatatgtgttaaggatatcgaaaaatctttggccttttataaaagtttattgaatcaggaacctttatattgtaatgatgatcgttggattacttttgattgtggtaattatttatcgctttacaataaacaatatgatattgatcttgtaaaaaataatttagatagtgataaatttaatcaagcatatttagagcttttagatcaagaggagagaagatataatgatcttgtagtatttaattttgaagtagatgatttaaaaagcgaatatcaaagattaaagacgttaaaaataggtgaactttcaaaaatatgttatgtaaatgtacatatgccatattggtatttcacaattaaagatcctgatggtaatgttttggaaataacgggaacatataaataaagtgataatcaaaaagccataaactcaattaattttattgagtttacggctcttttttttacaaagttttatcttttttcacagaactatcaattctgcgactttattatagcataaatacctacaaaatcaacaaaaaaattgtttatctgacaaatcgttattaagtaaactatcactcttgacttttttattctttgaatagtttacaacaaaatttattttcataaaggagaaatgaaatatgcagcaaaacaaaaaatttcttttagtagctagagaatggcttgaattaaaaaagatgtccgtaaaatattcatcatatgttaagtatgaaacagttattttaaaacatgtagtaccttttttcgataattatacattagaacaaatcactgatgaaatcattatatctttttttaaaagtttaattgagattgaaaaatattcaaatagtactctccatgcaattcgttatgttatgaaagctattttagagtatgcagaaaagaaatatagtattaaaaccattaattttagttttattagattaaatcgcacaaaagtaaattttaaggttttaaatgaagatcaaaaaggattattagaaagatattgtttcacacattatgaaccaatatcaatagctattttaattgctttgtatagtggtcttagaattggcgaaatttgtgctttaacgtggcatgatatcgatttaaataatggaattattgccgttaataaaacggttgaaagactaaaaaataaagaaactactgattctaaaacacttttaatgattttagagcctaaaactcatacttctaaaagaatagtacccatcccatcttttttaaaagaatatctttataactattaccataattcaacaatatctaataaatcattttacttattgactaatggagaaaaaattcccgatcctcgaacaattcaaaatcaatttcaaagattatgtcaagatcataatttccaaactaattttcattcattacgacatacttatgcaacccgttgtgtgatgcaggaggtggatctaaagtcattaagtgaaatgctaggacattcaaatgtttctactactttacaattatatgttcattcttcacttgaatttaaaatggatcaaataaataagatttctgctccagtaatttcgcagaattgatagttctgtgaaaacaaaagaaatgaggttaatgatgtattggtatgtagtccatgtaaaactagaacgaggccctaaactagttaacttttttaatcaacaagataggataaaagctttcattcctaaaatggaaagatggtacaacattaaaggaaagaaagattatattattaaagatttatatcctgattatgtttttattaaaagcgaaatgaatcaattagaatttaatgaaagatttaaagagttttttaaatcaattgatggttttgcccagttgttggagctagaagatgtttatgttttaaaaacagaagaacaggttctaatggaaaaactgtttgataataaagacataataagacattcaataggaaacatagttaattctaaacttattgttgaaaaaggaccattagttaacttagaaaataaagttattaagattgatcgtcataagcgattagcaattttaaagagtgattttttcaacagaataacagttcctttagaagttgttagtaaatcatgaactggtatgtgttatttgttttatcaaatcggtctaatcagcttattaagaatttaaataagaaggatagtatcgaagcatttatacctcaatatcaatattatcgtagggttactaaagactacgatataaaacctatgtttactaattatatttttgtcaaaacattaatgaatcaaactgaatttaacacatttttaatgaatttggataatgaaaaagatggtttgatcaaacaattagtgtatttggatacttcagctttaaaaaaagaagaaattgaaatgtttaattatttattagatgaatcttatgttgtaaaaatgtcccaagcatttttacaagatggtaaagcaaaagtctatcatggcccattaaagcattttgaaaaaaacattgttaaagttgataaatataatcaggtagcatacctaaatttatcttttatgaatcgaaagataaaagctggattgaaaataacaagcaagaattaagctggggagaatggtttaccgcccccagccattattttgaacatacgtctttcttggggtaaggggagactatgttcttttttgtaaattagagtaagtaactgcataatgcagttttttgttatggaggggacaaatatgtcacatatatttttagcatcaccacatatgagtgatgaaggttatgaacagaagtatattaaagaagcatttgataccaactggatcgctcctcttggtaaaaatgttaatgaatttgaaaatgaaatgatagataagcttggtgctaaagctgcagttgctttatcctgcggtactgctgctatccatatggctttaaaaagtattggtattaaacagggtgatcttgttttttgtcagactttaactttcagtgcttcagctaatccaattacttatgaaaaagctgtaccggtatttattgacagtgatgagtcatggaatatgtcgttaacggctttaaagaaagcttttgaaaagtataaagataatctgcctaaagctgttattgtcgttcatctttatggattagcagctaatattaaagaaatcaaagaaatctgtgatgaatatggtgtacctttgatcgaagatgctgctgaatcattaggaacaacagtaaatggtcagtatacaggaacttttggtgattatggcatcatttcatttaatggaaacaagatcattacctcatcaggaggtgggatgttgttattcaacactgatgatgctgcaaaaaaagcaaagaaagtattattctggtcaacgcaggcaagagaacaggcaagacattatgagcataaggaaataggttataactatcgtatgagcaatatcgtagctggaattgggagagggcagttaaaggtactggatcaaaggatagctaagaaaagatatatctatgaatactatcaaaaagagatagggagtctggaagggctaacgatgatgccaagagacaagtatggatcatattccaactgctggctgtcaacaatccagatagatgaaaactgtaaagtaagaccaatagatataatggtagcgttggaagaaaacgatatcgaatcaagaccggtatggaaaccgatgcatctacagccggtattcaaaaattatgattatatagataacgatcagacatcagaaaagctgtttaataatggagtatgtttaccaagtgatacaaagatgaatgatgaagatctggaaagaatctgcaacatcataaaaggattgtggaaatgatggaaaacaggcataaagcatatggaccatatgaaaagtatttaaaaagaccgatagatatcatctgttctttactggcgctgatcgtatttagctggctgtatctgatcattgcactgttagtaaggatcaaattaggcagtccggtactgtttaagcaggaaagaccaggtaaagatgaaaagatattcaatctgtataaattcagaacgatgacagatgaaagagatgaaaagggtaatttactgccagatgaaatgcgactaacaaaatttggaaaattattaagagcgacaagtcttgatgagttaccggaagctttaaatatcttaaaaggcgatatgtcaataattgggccacggccattattagtaagatatctgccaagatataatgatgaacagcatcgaagacatgaagtaagaccgggattatcaggatatgctcaggtacatgggagaaacaatattacatggacagagaagtttagactggatgttgaatatgtagatcatattacatttataacagatgtgaagattttgataggaacagtacataaagcatttatcaaacaggaagggatttcttctacaacgtcggcaacaatggaagaattcatgggtaatatcaatgaatgagagattaataattattggagcaagcggacatggaaaggttgtcgcagatattgcagaattaaatggatacaaagagatagcctttttagatgatgatagatcaaagaaaagtaatggtaaatataaggtaattggtacatgcagtgatattgataaatttattgatgattatgatttctttgtagcgataggaaataataaaatccgaaaaagaatcacccaaatcttatcagataaagatatcattcaaccagtgcttatacatcctaatgcaatagttgataaaactgttttaatcaaagagggaacagtggtaatggctaatgcagtaataaacgcagatactatgattggaaaaggatgtatcatcaatacagcttcatcagtagatcatgactgtattattaaagattacgtacatatttcaccgggagtacatatcgcaggtacagtaagaataggaaaaaatgcctgggtaggaacaggaacatcagtaataaataatgtaagtattactgatgactgtataatcggggccggagcagtggtcatcgatgatatcagtaattgcggtacatatgtgggtgctccagcaaggatggtgaggaaatgagaagaatcctgattttagctaataacgatataggtttgtataagtttagaaaagaactgattgcaaaactgataaaaaccaacgaagtatatatatcactgccatatggaaaaatggtagaacctttgattaaaatggggtgtcattttattgatacatcagtagacagacgagggatcaatcccgtaactgatctaaagctgttaaataaatatcgaaagatctttgatcaggtgaaaccagatcaggtaataacctatacgatcaaaccaaatatctatggcagttttactgcgcggataaagaaagtagaatatgctgtaaatattacagggttaggaacagcgtttcaaaatgataatctgttgaaaaagattatcatttttatgtacaaaaaagcgttaaaaaaagtaaaaactgttttctttgaaaatatcgaaaacagagatatcttcattgaaaacaggatcatagaaaaagataaaacatgtcttcttaatggagccggagtaaatacagaagaatatcagtatgcagaatatccagatgaaaataaacatatcagattcctgtttattggaaggatcatgaaagaaaaaggaatcgatgaacttctttatgcagcaaaaaagataaagaaagagtatgccaatatagagtttgatatagttggtcccatggaagatgattataaaaataaaattgaagaatatgtaaacagtaacataatcaattattatggatatcaaagcgatgtaaaaaaattcataaaacaatgtcattgttttatattgccttcataccatgaaggcatggcaaacacactactagaagcaggatcaatggggagaccattgattaccagtaatattcatggctgtaaagaggccattgataataatggatatttagtaaaggtaagagataaagaagatctgtatgaaaaaataaaaatgtttattgagttagatcatgaaaagaaagttaatatggcattaaattccagaaagcatatagaaaaaatatttgataaaaggaaagtagtaaaagagactatgaaaggattgggattatgagtgaaccattaatttcgataatcataccagtgtataatgttgaaaaatatttaacacagtgtttagattctgttataaatcaaacatacagaaatatagaaattatttgtatcaataatggttcaactgatggtagtgaaacaatattaaaagaatttcaaaagaatgataaacgtatcaaagttattaatactgttaatgaaggtgtatctattgcaagaaataaggggctggaaattataactggagattatacgatgtttgtggattcagatgactggatagatttagagacttgtgaagaagtaatgaaagttgttgctaaaaatgaagcagatgtagtaatgtggtcatatataagagaatttgaaaataagtctttacctaaaaaaatatttaatgaaaatgaaatagtttttaaaggaaataaagttagaaatttacatcgaagatttgtgggattaattggtaaagaactttcaaatattgaaagtgcagatgcgttatgtccagtatggggaaaaatttataaatcatcaatcataaagaaaaataaaatagattttgttgatattagaaaaataggatcatatgaggacggattgtttaatttggatttatttaaatatgtaaataaagttgtatatattgataaacattattatcattatcgtaaaaataatagtattagtgttacttcaaattacaatgatagactttatgataattggcagaatctttatgattttatggaaagatacatcaaggataattttttaccggatgaatatataactgcattaaataataggatcagtataggaatcataggtttaggattaaatgagatgtcatctaatgataattttattaacagattaaaaaagataaattatatagtcaaaaataaaagatataaaaattcaataaagcatttggaattaaaatattttccaatacactggaaagtgttttttttatgtgctaagtatagatgttctttagaagtatatatttttttaatgataatttcatatattatttctaaatgacatatttaaaagaaattataaaaatattgttaaatattttatatttttaatataaaaaataaaattggatgtttactgtttggttaaataaaatttttagaaaaaatatttttgaaagaagaaggataaaaataatggatgatagtataatttattttagtataattattcctatatataatgtggaaaaatacttaaaaaaatgtgtaaatagcattttgaaacaagaatataaaaattttgaagtaatattagttgatgatggatcaccagataattgtccaaaaatttgtgatgaatacaaaatgaaggatagtagaattaaagttattcacaagcaaaatggtggattaagtagtgcacgtaatgaaggaatgaaaaaagcaattggagattatcttatatttgttgatagtgatgattattggaattctagtgctgcgcttactaaaatatatgaaaaaataataagtttacattcaagggttgatgttcttatatataataatgttgatcattcatgtattagtaatgaagatataatttgtaatagaaattatgatgaaaaaaaaatggagacttctgaaaaatatgatgttttaaaatatttatttcaaaataatttatttcctggtgcagcatgggtgacagttacacgtagaaaattattaattgataataatattttttttatagaaggaattaaagctgaggatattgactggcttttaaatgtttttttaaaggctgattcatattcagctgtaaatatggctttttatgtatatcttaagaatagaaacaattcaattactggaactgctgatatgaaatctatagatgatattttatatatattacaattatggataataaaattaggtaaatatccaaataaagaaattaaaaattatatatatggatatttatctaagcactatctttgtgcattattaatagaaaaacatataaaaaaaattgagaagaaaatgcttaagcctaaattaaaaaaatataaatttttacttaaatataacaatagtattttagttaaatgttgttattatttaccattggaacttttatgtatagtattaaatatattttataaatggaagagaaaataatatttatgaatcaaaaaagagtattaaatcaatctgtgattttttttatgtttatattattatttagttatacattatctgtattttattcacagcttagagaagtaaacacatttgtcataacaattgaacttttaattataggatgtctatttttttctaatttatctaaattagatggatcatatggcatcaaaataggatatatttttttactattgtttgtttttcgtatggttttattattttatcagtcaacacagggaaatctaccaatgagtggtggtgattcggcagtttttcattcaaatgctaacaaaataattacaaatgctaataatttttttcaattattagttcctaaaagtactttagaaaatcggggtgatttttttgaacgattagtagcaataatttattatatatgtggtgtaaaaacacaatacatttatttttttagttatattatgagtgaaatagtagttcgttatatttttaaaatatcgtcttatctttcaaaaaaaagacatgtagcaactatatcatgtttaattttttacatttggcctttagaaataatatattcagtggattatttacgagagatgactacacaggcattttttgcaatatcactatattatttcattagatatctttttgaaaatgatatccgaaagctaataatagcatttattttttcatatatatgtacagggatacattcaggaatgatagcaatattcgctggatattttgcagtattatttttttatagcccaaaaacaagaaggttacatataacactatttcggattgttattgttattttattatttgctttattgtatgggtctggtgtattagatagtgttactgggagatttagtaatattaatggccttagttcattgacaagagattccggtgtaattggtatgacagattatattagtacaccaggctctacattaggagttattattcagacacctatacgattgatttattttattttagccccgttaccatggcatgtaagaggtacaagtacatttattgcgtttttattggatggaacgttaagaatggttattgttaataaaatagtcaaaaattatatgagtataagaaaatctggcaatattgagcaaaaagctgtttttattatttttataatactatggcttatgacagatttagttttctcatggggaacaaataattttggaacagcaatgcgtcatagactgaaaatatttcctttagaaattttacttatgtacgtattgagctatccagtaaagtcttttaagttgagaaaaaaataataatgaggtaagttatcatgattaaaaatgaattaataagtattattgtaccaatatataatgttgaaaaatatcttgaacgttgtgttttatctattatacatcaaacatatcagaatattgaaattattttagttaatgatggatcaacagataaatcaggtgaattagcaaataatttagcaaagaaagatgcacgtattaaagttgttcataaaaataatggtggtttatctgaggcaagaaatgagggaatcaaaaatagtgtaggtaaatatattttattggtagattcagatgattatattcttgaaactacatgtgaagaacttattcaaattgccattgaatatgattctgatatggtctcttttagggaaaaaaaaatatatgaaggtaatttaacaggtaataataagcaaataccagatacaaaaaatataatacttttaacaggaaatgaagcaggtaaaaattatttatatgggagatatatacagcactcagcatgtagcaagttatataaacgggaattatttgataaactactttttcctactggaaaattagctgaagatatggcaacaacatatttatatgtttctttttgtaataagataatattttatgatagacaattgtatatgtattgcattagagagaatagtattatgacacaggctagtttgaaacttgtacttgatgtttatgataattcttgtaagatttatgaatttgaaaaagaaaaattttttgaacatcttccaattatagaaacaaaatattgcaactgtttattaaaaacaattgcgcgaatttataatgaaagaaataattctgacttgtatcaaataaaaaatgatatagaatatagattaaaaaaagtagacttaaaattagttcccctaaaaacaaaaggagtttattttttatatacattaaataaaacgatattttcaaagattatgaagaaaataggcaagaatggataaaaaatgttaaatatatatttttatgttgatttttagccttgtataattccacatataatatggaaaaattaataaaatattttattgctaatattattatttgctttttatatgaaaagtaatagttgaaaatataattgattcagaattaaatcagataaaatatataaacattgcattggtagtacaatttataagtatataaattataatatatataaatgaagaaaataaaaatgtttttactgatattatgcctattaaccgtatttctgatttgtaaaaaatatattgtatagtaaatttgtgactatttttggaatgttatcatgagaatttttatattatgtaattgattaaaagagttagttatagagtttttttatatatttacaatttatctatagattatgcaattaaaagattataaataaaatttagaagaggttttgaaatggaaagaggaagtctaatatcaataatagtacctatatataatgctgaaaaatttttaaaagagtgcattatatcacttatccaacagagttacaagaatctagaaataattttgattaatgatggctctaaagattcgagtggaacaatttgtgatgattatgcaaaaaaagataagcgtataaaggttatacataaacaaaatgaaggtgtatctatagctcgtaatataggtttggatgttgctagaggaaaatatataggttttgttgatagtgatgacatatgtgaattagatatgtttgaaaaattatattatgcaatcagtgaatcgaatgttgatatagctttatgcatgttttcggattatgtagatggaataaaaaaggaacacaaagaacctattaaagttggaaaatatgataaaaatcaaattatcaatgaaataataatgccaatggtaggatcacctataacgtctccacaatgtgcaccagtaatgggaacattgtggagatgtatttttaaatatgacataataaatatatctacacctttacgaatgaaaaatataaaaatagcagaagatttattatttgatattgaatatctgtgtagatgccaaaacgcaattgtaattggtgatgctttatataattatcgtatgaacgaatcttctgcaactcatttatacattacagatttatataataatatttgtattcaaatgaaactaatgaaagatgttttgataaaagaaaatttgttttctaaacttatggaagagcactatgcaatgacagttttatataacttgacatggtgtattagtaatgagactaagagaagtaatcttctctcgaaaaaagaaattataaaaaaaatcaaaggatatagaaatttaactgattataagaaagttttaaaatggtcaattattaaaaatataaaaactaatgaaaaatattattttttaatcataaaattaaaactttatcatttagtttttttgtttaataggaaggattaaagtctgaaaagaaaatttattattaattgaagaaaacaaagatgttagtgctattatttcttttacatggtagtattcaaagttcatttagggtaatagtaaataggggattatatgttcgtgtttgagagatgaaagtggacgaaaacggaggaatatatgaaaagagaagtattaatgattgttaacagtttgtgtaatggaggggtggaaaaagttgtatataatatagctactggactagattctaaaaagtttttaatttatatttatgtattggatgatactaatgattattatacagagaaattattagagcatggaatcattgtaataaatagatatgcaaaaataagaagaaaaaaaaatataaatcaatatcaacttttgtttacagaaattaatcattttttaaaaaaacataagaatatttctgctatacatgttcatgaaactaatcaagctttagcagcgcttctggctgcaaaaaaaaatcaaatatctgttatttgtatgcactctcatgcggcgtattcagaatattggaatccaaaactatttccgttaaaaagtcgaattgctgaaccgattatgagattatttgaaaagtatataccaagtcataaaattggatgtagttgggctgcatgtgaacgtatgtttggaaagagtaaaaatcaatactttattcccaatggtatagatatggataagtttaattctagtaggatagtttctaaaatagaattacagaaaaaatatttatttgataacaatgactgtaattttatttttgttggacgcttttcctctccaaaaaatccgctatttatgttagaggttatatcaaaattacgtgaaattagatctaatataaaactatcaataataggatatggagaaatggaagaagaaattcgtttaactgtgaaaaaattaaacttggaaaatactgttcgttttttatcttctagtagtaatattccagaattattaaaagcatcagattattttatatcaccctctatatatgaggggttgggaattgtttttgtggaagctcaattaatgggaattccagcatttgcttctgatcaagtacctaaagaggcagatttaggattgtgtgaatttgtcccattatctctaggatcaagtgggtatgcaaaatatatagacaactatattttatctgaaaaacaaaaaaagaaaacattaaatttagataaggttaaattatatgatatgaaagaagttataaaaatttatgaaaggatttattgtggtgaaaaagttgaataatatcaataagataatgatttatgcatatacaagatttaatttaggagatgacttgttgataaaaatcttgtgtgataggtattctggtatagaatttcatctttatacatatcctgaatataaagatgcattaagcatttgtaaaaatttaaaaatacattctaatgctaaattccaagcaaaattaatcaatacttttggaaaaataataggtaacataaatgtttatgaacagatgattgctaaaaaatgtaatatatgtgtttgtattagtgggtcgttgtttattcaaggtggagataattggcaatcatattttaattatatgaaatcacgtaaaattaaaaatataccatattttcaaattggatctaactttggaccttatacagatgaaatgtttttaaatagatttcgagaattattttttacatatgaggatatttgttttagagaacagtacacagctgatttatttgctggtttaaaaaatgtaagagttgcgccagacgtagtattttcaggtgactataaaaaatatataaaaaatagtacagaaaagagagtcgctatatcggttattgatttaactaatcgtaatgatcttaagcaatataagataaaatatttaaattatatagaaaaaatatgtagaaaatacttgaatgaaggatattgtattgatttgctttctttttgtaaggctgagggagatgaaaatgctgtagcggaaatggaaaggcgtttaaataaaagaaatgtaaaacattatttatactatacagatactgatttggaaggtattttaaattgtatagggtctgctgaaattgttattgcaacaagatttcatgctatgatattgggatggtgcatgggtaagaaaacacttcctattgtttatagttctaaaatgacacacgtattagaagaatttaaatacccaaataaaataataaatataaaagaattggaaaatacatatattgatgaattatttataaattacagttttgatacttataatataattaatgaatctcagaaacaatttttaaaattagataaatttgttatcgggcaagaggattaattaaatgtaatgtaaaaaagttaattatagaaaattaatatattttaatatcttaagctttatagtttgtttttataaaatcaattgtattggaaaatataaccaatttgataaattttattaataatttaaagctgatacatatttttataatatattttcttaaacaaactatattatatatcatcatctaatcccaaattttttattttcaggtaaagcaatataatgaaaacattagttggtatgatagaagagctattataggaagtataaataaaattataacaattaataaaattatagtgagtaggttaggatataatattattaaaataaatatataagattatcatactagcaataatagtataataaattaaaataatgaaagattatcgataattattttaattatcatacgtaaaatttaagtaaataagaaatacatgatttaaaatagaaaatttttgaaacagaagagaatgaagtaaaaatatagaattaaaaatggatttatgtaatattttttatgaatattattaattagaatgaatattttgttaggagaataaatgtgagaattaaaaaaggtttatacaatattttttttgggtttataggacaaattattacaattacattgggaatcattattcctcgattgttcattttaaatttaggatcagcagcaaatggtttactttcttcagttggacaagttctatcttatcttactttattagaggcaggattaggtggcgcttctattcaagcgttatataaacctttggcaaataaagatatcgagggtattaataggatattatctgcaactagtgattattataaaaaaacagggaaaatatattttttatgtgttgtgggaatctcattaatatatccactttttattaatgagttttcatatctggttgcttttatggtaattttactatcaggtgtaccaggagttttaaattattattttcaagggaaatttcgtgttttgttaatggcagagggtaaatcatatattataagcaatatttctactgtaatatcagtattaacaagtattagtaaaattatacttataaaatttggatgcaatataattcatcttcaaatggtatattgtattatatcgatatttcaagtctttatttatgaatatttatttaaaaaatcatataaatgggttaaatatacagctaaaccagattatttagctataaaacaaaaaaattcagttttaattcatcaaatttctaatcttatacttacaaatactgatgtttttatattaacgatagctactaatttgaaagtggtgagtgtatatactgtctataatatggtttttgacatgattaatacatcagttcaaacagttggaaacagtgtgtcttatatttttggtgaaagtttttatacaaatagaaaaaagtttaaaaaaatatttgatgtgtatgaggtttatttttttaattttacattttctttatatacaattacgttacttttaattataccttttttacgtttatatacgaatggtgtttctgatattaattatatagatttttatttaccaatcttatttactcttatgaagcttttagcgtgttcaagaacaccagctttaaatattattaatgttgtaggtttgtttaaagaaacacaaaattctgctattattgaggcaataattaatttaagtgtttcaatattcgctgtatataattggggtatatatggtgtaattattggtacaattatagcactcttatatagagcaatatacattgtcttatttgcaagtaaaaatattttagcgagaagtgcgtttaaaacatttatacgttggggaattaatattttaattttttgttgtattatttttattgagaaaaaaatatcacgtattgaaatctttggatataaagatttttttgtttatgcaattatttatagtgtagtggtttgcactatttttactctaattaattctttgattaattttaaagaatctaaattgatatttagcagtatatatttaaaaatacaatcaatgaaaaataaaaaaagattaaaaaacatataaattaaatgttttaaaatatattattcaagttttgtagtttagattccatctaatctagtcactcatagaaaaactgtattcaggtgaaggtttagtatattaaaataaaaattgtattgattttatcgttgtttttataataaaggttatacaaaagaataagttcttaatgaattaaaagatattcaaaaacaattatagttaatatacaagaaactactaaatatttattatgaagaagtataaaaaaagaagtaaaaacacttttgttgaagtatataataatgaagaataaaatattgtattgtaacgatagatagaccagtttgggtgttatatacttaagtgataaagatgatgatggaaatggtattaagtgaagaaaaggctaaagaaaataacattgatattaatgagtgctatgaaaaagtcgatcgttttttttaaatgaagagtcaaaaaattataagaatgcctggaaagatattaaaaaatattttgaaagcaaaaattttatacaccgtcagtattctggttatgtttcaaatgattttatttcaatacagttatagtagaagttgttttaaatttatttggatatctaattgatgtgataaagatataaaattatatatttgtaaagtagggtaacatgtatattattaatagataactaagtattagagtgaatgtttctagagtaataggaaaatttaatgaatataggtaatttagggagtatttattgaaaaatgtaaaacacataataataggttatattaatataaaactatgaaaagaggtatactgtggaagtggagaaatttttgaaagattattatggtgataaacaacattttaaatatgttgctgattttttgtgtaaaaaggaaaatttttgtcatgaagaaattatagtcgttgattcatcacagggttttggcaaaacattcttttctcaaaaacttaaagaatatattaaagaaaaccaaaagaatgctatagtagttgaatataatttaagcaaatatgatcatggtgattgtttaataatgttttttcataatttatttgaaggaattcaaaatgaaatcaatatttcgagagatgaaagtttaaaaaaaatttacaaagattgtatttcaaatttaataagcgcatcagaagatattattccacttaagtatagttatttttttaatatctctaaaaaagtaagtgatataatcaaatgcattaacacttatggtacattaggcatagattatactgaagataaaacttccaatgactatataagtaatattgtaaaatttaggaaaaatgttaatgaaatattgatgaaatatgataaatatttgctttttttcttaacgaatgctgataaatgtaatgaagattttctttttgattcactgttattaatgaaatatttttttagtcagagtggtttaaatgttggaattttgttgtttgctaatatccagtatttacaagaaatttcatcagctaaacatatgtctaaaaccaaaggaaatgaattttttggaaactatttttataaatatattacaattcctcctccgaattataaatatgcaatcgagaatatggtgactgaaataagtttttctaataatatttttgatgattcaaaaataaaacaatatttatttgacttgacattaagctattatccacctattagtaaattaaaaagattgatattgaatttttcgaattatttttcgatttatcaagataaagaatatgatccagaagttattaaaaattatctttgtatttgtgcagtaaaatactttgattatgaggtatataggcgacttgtattcaacaaagttatagataatgaagttgatttctattttagtaattcatatttacaagtaggattagaaaataaatctgcgtttattgataatactagggaacatcgtttatttaataatattgatgggacatttgaatatattgagttatatggtatagtttcatgtaaaattattcaagataacaatagagagtatcttaaaatagaatatgaaggtgataaaaaacgttattattatgttaataaaagtagtagtattgaccatttaatcggttataaagaatttgaagtattaaatagatatttagatactgatttatttagctattttaatcgaatttgtagttttatataaatattgcatgcatgggatttcgtgaaatgcaattttttgtttaaaaacagaaaaagctttatcacgacatctaaagcatgctataatcataaatatgaaggtagagaggagaatactgcaataaatattgtagtaattattaatatgagaaaaagattttataaagttagtacaattgatagatctatcaatttacttagacctacaggaaaaaaatttaggaatgacataatgccagatagtcaatattatcgtcctgataataacaaaaacacttctctaggccggtgtgttacaccaatgtcaaaatataaggattagatgatacttaaagtatcattttttatttagaaaaatggagataggtatggaaatttataaattagaagtacacaaagatattaaacattcttgtgaggaaataaataaatcaaatagctgtatcgacatagtattaggacaatttgattttgcttccctaaaagaagaagcttatgaaacatttgataaactttttttaaatgaagggacaaaagataattatattaaacaaacatttttaatttattctactaatgataaccagtttattaaaaataacaaaaataattatgcttatagattagtaacattagcatattacaatgattcatattatttaaaaccaccaatggatataaacgatcaattatatgaaacagatgatgtaaaatataaagtttataatacattagataatgctgcttttgtaattgtgctatttgctaataattattctgatgctattaaaacactgtataattttattaaaataaataagagatattcaaatttttattatactattttatcaataaataaacaaaaaatttctcgattagatgaaaaagttactgctcaaattaatttaagtatagataatcacagtatggtaaaggaattgattcatagcattattaatgaattaacaccagataagtatcatattatgccattaataggtaataaagatttacaaatatatatagaaaagattaatataaataagttgctaacaattcataataaatatttaaaaatggctaatgtaaaaaatggagaatcaacaatatataatgtatgcactaatattttgcatgaattagattctatagataaaattaatgaattttttgaaataaaagaaattaatgaattaaatcaaaatacatacatatcattaaatgatatatatgaaatgattgcaacagttgatgaagagcatgcagatttaaaatcgtttattaattatttgaatcatttaaaatataattcttttctaaaacctctttgcttatcgatttatccttctttaaaggaaattggtaatcgcaatgatcttgatgaatcgttagtatctttatattgtgatgaaatatataatatcacaaatataattatggatacttcattgcatacctatcatgaccctgctattaaaccaattcaacattttattccagaaaaaattttaaatttttatacttgctatttatattgtttaaaaaatgagttaataaatattgatggtgatgggtacaaattcgattttctaataaaaccagttaatgaaaaacatattaaggccatctcaatgcaaaaagaaacaaaccctactgatcggattattttgattaaattacctattcatcaaatatttgaattagatttagtgatttttcaattaactcatgaattagctcattttgtaggtaatttaacaagaaaccgtcgagaaaggttgggattatttaataccttttttgcagattatattgtggattttttaataactgatttaaatttaacagacggacaaaataaaaatatatgtaagtatattaaagatgttgttgaacgtattacttttaaagaatttgtagaggaaaataattattatttatacaattttagaagaatatgctatgatataacacaatatctacaaaataattttgataacattaatctatatttgctgcaactagttaatgaaagtgaatcattagatttgtttatacatagtcttgcaagtttgtttagttttgctaatgatacatttttggtgtatggatatgaagaaatcgaatatctttgccgggaatgttatgcagacttagtagctattgatttattggattgtgattatgaaaattatgtatcctatttttatcgaagttgtgagttggataaaaattatgtcttagaagatttggatgttattaggatatcattagttgcttctattgcttatgaagatatagagaatttacataatgagaaaattgaggcaagaacacaaataaagattaatgagtatactaattatttgaagaaaaacgattttgataaaattatggctacacaaggtgttagaactgataatatagtaatggcattaaagagctatttatctggatgttatggtatgattcaacaactaaaaacaagttctaattttataaagcaattatctcgctattttaaaatttttacttgtggtcaagatattgataaaatagttgaaataatgcaagaaattatttttaagtattatcatcaatatatcaataaatagcatgtttaataataaaatattaataactttaaagtgaaaagttattttttattataaagatattgaaatataatttaacttttgaaagataaacttaaaattatctggttatgtgaggtgattaaggaaagaataggttttaattggaggttggtgtaaattgatgaggtttttacttttttaattgttcatttttaagatgttggcaatgacatagataaaacaattggcaataaattgatgtattattttcatagaaaatattaatgacagtctatttgttattagtttaaagattatgttacataagttaatctatgatttagtaaatatgctaaatgatatttaattgcagaagaaaaactatataataggaagaatcgttaataatttggtaaaaaattattggtttgaaagcgatacaatatattaaaaatggatagtaaatttcatgatatccaattaaaattttctaaaaattcattcgaaaagaaattttttaaatgttttaaaatagaggaaatcgctgaaattactgaaaataatgatggattaaaaaagataaatattgataaaaagtaagtcataaaatatttaatatttcattaaatctaatttatttcatactattagatataaagatatttcttgatgtagaacttgtgtatttgcaagttctttttttaaggagccaccatttattgatggctcctttactatgttatattcaatatcttaaaatataattaaaatttatattttagttattgatatagaattaatattatattaagataaggtgctgatggtgaaaaaacagaatttgattttaatgatgggggataagatgtttagttttcaagtagatttaacaaaagataaaatattaaaagcaatactgatatttgcgattccaatttttatttcaaatatttttcaacaattttataacacggtagatacaatgatcgtcggtaattatttaggtgataattctttagcggcaatcggcgcttgtaatgcagtttatgaattactcgttggatttgctttaggggtaggaaatggatttagtatcgtagttgctcgtagttatggcgctggtgatgaatcattattaaaacgttccgttgctggagcaatagtaattggaattattttatctttactaattgttttgatttgtcaatttggtttgtatccactattagaattattagatacccctaaaaatattattgctgaatcatattcttatatctcaatgattacgatctttgttggggtaatgtttgcttataatttatgtgctggattattacgagcaatcggaaatagttttatgccactattctttttaattatatcatcagtaattaatattgttttggatcttatttttattactcagtataaaatgggaatccagggagcagcagtggcgactgttattgctcaaggagtttctgctgttctttgtatcatttatatgttgaaaaaaacaactattttgattccccaaaaagaacatttcaaacttgataaaaagttatatcaagagttagctggacaaggtttttcaatgggatttatgatggctatcgtttcttcaggaactgtaattctccaaaaagcaatcaatgggtttggatatttaacgattgcgggtcatactacagctagaaaaatcaattctttttgtatgatgccagcatcaacgattgcttcttcgttagctaccttcgtttctcaaaacagaggagctaataatcgtaaacgaatccttgaaggggttaaagcagggtataagatggtcgttatttggggtgtgattgcaacaattttactgttttttacagcacgaccattagtttctttattatctggttcatctcaagcaatcgttcttgataatggttctaaatatttaatattaaatgccccattttatgcggttttaggaattttgttgattctacgtaattctttacaaggtttagggaaaaaaatcgtgccacttatttccagtattattgaatttattggtaaaataatttttgtttggttctttataccaaaactaggatatcttggagtcataatttgtgaaccggttatttggtgtttaatgtgtagtcaattgttgtattcgttttatcataattcatatattaagggtaaatctaattaggtttatccttttcttattttgtaaattaattaattggtaaaaagattatgataagataaaagcggaggtaggatgatgaaacgtaaatttttcttttttgatattgatggaacattagcagtaggtacgccgggtaaacaatatgtaccggagtctacaaaattagctatatctaagcttaaagaagcaggacattttgttgctattgcaacgggtcgtagttatgcgatggcagtagaacatatgcgacagttaggatttgaaaatatggtcagtgatggtggtaatggcattacgatcaacaatcaattaattaaaatcaaaccgttagattatgataaatgtttagcactaatagatgaatgtattgaaaaaaattatatatgggctatttctcccgataatactaaaagaagattggctccggataatcgtttttatgattttacccatgatatatatatggatacagttgtccaggaaaacttaaatcccttagattttaaagaaatatataaagtatacatagcttgttatagtcctgaagaacaaaatttagaaactttaaaacaattaccatggtgtcgttttcataaagaatatctctttgttgaacctggtgataaatcagtagggattaaaatgatggttgatcattttaaaggtgattatcacgatgttgttgtttttggcgatgagaaaaacgatttaagcatgtttaaagatgaatggacaagtattgctatgggtaatgcaattgatgccttaaagcaaaaagccagttatgttactgatgattgtgataaagatggtatttataatgcctgtaaacactttgggtggatcgattaatgtcagtcagccgtttatttgagacagtttattatttaattgaacataaacagacaacagctaaagaattagctgagcattttgaagtatccattcgtaccatctatcgtgatctagatcgtttgctggcggcaggttttccgatcaatacatttcctgggagtaatggtgggatagcccttgatgaaaagtttgttattgaaaagaatttttttgattttcaagaacaggaacagatcttagcagcaattcaaacaatcgaaaatttacaaggaaataagcaaaatattttaatttctaaattatcatctttattcgatactcagcggcgggattggatcgaagttgattttaatacctggcatcaggataacaaactcaatgataaatttaatttgttaaaagaagctatttttagtaatcaggtagtagaatttaaatatatcgattcttatgggaaaaagtcaaagcggcaagttttacctaataagttgttttttaaaagcaatacctggtattttcagggatattgtttgaataaagaagattatcggatatttagattaagccgaatcaatgatttaattttaacggataaagaaattaatgatattagtaatgatcctcctaagatcatcaattatgatgatgattcaccagtaatcaaagtcaaattaaaatttgataaaagtttaggaagtgttgtatatgatgaatttagtaattctttgatcacattagatgatttaggtaattatattgtggaaacaactgtagctaataatttttggttattaagttttattctttcgtttggcagtcaaattgaaataatcgagccagttgaaataaaggaaaagttattaaaagaagtagaatcgatcatgaagaaatatcgataatataattgtttaataaacctgacaaatgatgtcaggtttattttgttataatattgatgaaaggggataggtaaatggaaataataacagtggatgaacacaatattgatcaagaacatatttgctgtgcgatttcatcgagtaaagatcttcaagtaataactaaaaagaattggttaaaagagcgctttaaagacggcttagtttttaaaaaaattaatgttagaggaaagtgttttgttgaatatgttccagttgaacaagcctgggttccaataaatggtaataatttgatgtatatagattgtttatgggtagctggtaaatatcagggacagggttatgcaaaatgtctattggaaagctgtatcaatgatagtaagagaaagcaaaaagatggtttagtgataatttctgcaaagaaaaagttagcttttttaatggataaaagatttttattaaaacatggttttgaagttgttgattgtattgatgataaatatgagttattgtttttaagttttcataaaaatgtaagtaaaccatcatttaaatttaaacaattgatgatagagcaaaaaggtcttgtattattttatagtcatcaatgtccatttacagttaaatatgttgatttgattgctaaatattgtcaagaaaataaaattgatatcgaaatcattcatattaataataaagatatggcacaatcagcatcaactatttttactacatatagtttattttataatggcagattaattactaatgaaatactctcagtaaaaaaatttgaaaagatcgtaggtgaagtacaatgaaaaaaatcgattataaaaaagaatacaaagatttatatttaccaaaacgaaaaccaatgttgattgatgtaccaaaaatagtatatgttactgtagatggtagaggtgatcctaatactagtaatgagtacaaagaagctttagagttattgtatggaatatcttatacgattaaaatgtctaaaatgacagatgataaaattgtcggttattttgaatatgttgtaccaccgcttgaagatttatggtggttagacgagcaaaaagaagatttaatgatcagtgataaaagtaaatttaattggaaatcaatgattcgtttaccagaatttgttactattgatgtatttgaacacgctaaagaagttttaaaaactaaaaaaccaaatttaaattttgacaaagtaaactatgaagaaatcaatgaaggaaaatgtgttcaaataatgcatattggaagctatgatgatgaagcagtttcaattaaaaagattcaagattttattattgaaaataatttaaaaatagatattaacaagcaaagaaaacatcatgagatatatttaagtgacccgcgaaaaacaaaggtcgaaaatttgaaaactgttattagatacccagtaaaatagaactaatagataattttttcatacaataatataggtgagagtatggaagattataaaaaaactgtttttaaaatatctacaataactttaattagtaatctagttttatctttttttaaaatattaattggatttatttgtaaatcaaatgcgatcatatctgatggtgttcatagtgcaactgatgctttaagtacaattgttgttatgattggggttaaattatcaagcaaagaaagcgataaagaacatccttatggtcatgaaagatttgaatgtgtagcagcaattattttatcaatcatgctatttttaacagctagtattattggctatagtgcgataaaaaatatatttactagtaaccataaaatttatttagggggtcttgcgatacttattgctgtaatatcaattatttcaaaagaactgatgtattggtatactaaaataaatgctgatagaatcaattctaatgctttattagcagatgcctggcatcatcgtagcgatgctctttcatcaataggcagtttgattggagtaattggtttttattgtggttattatatattagattgcatcgcgggaatcataatttgtttttgtatttttaaagtcgcttatgatatatttgatgatgctatcaataagatgatcgatcatgcttgtagtgaagaattcgaaaatgagctaattactttaataaaaaaccaagatggtatattaggtattgatgtttttaaaactagaatgtttggtaataaaatatatgttgatatcgaaattcgagtatctggtaatgatacgtttcagcatgcacatatgattgcgcataaaactcatgatgttattgaggaaatttatccaatcgttaaacattgtaatatacatgtaaatcctggaaaaatcggcagttagtcgattttctttttggttatataatcatgctaaggaataaaattatatacaaattagtaaataagtattaaaataaatgaggataaaattatatgtgttgtaatattttattgaaataaaagatgttttaatcagtgatgaattaagatcgttagtacatcaataaatagaaataacactattttgattagtaaaaattgttggtatttaaatacagatggaataagctgtttaagagaaaattactttttaaaatgaaaatataagtgtttgagttttaagtgatttgtatcagaatagtagaataaaaagttataaatcagctttgagaatatgtatgtttttaaattatcattgaagtaaaaggagaaaattaatgaaaatagcagtatataattatcgagaatttgatgagggaaaatattttcaaaaatttagtgaaaaatataatgttgaaattgttaaatgttacgaaacaccaaacattgaaaatgcagttctagcatcagaatgttatggagttagtgtcataacttcagcaataagtgaggatattataaaatgttggcatcaattaggagtaaaacatatttcaacgagaactattggctatgatcatattgatcttcaagcagctaaaaaatatgatatggaagtaagtaatgttacatattcaactgctagtgttgctaattacacagttatgacaatgttaatggctcttagaaaaatgaagatgatcatgaaaagagctgatggctgggattattctttaaaagatagtataggtttagaattagaaaatatgacagttggagtggttggtacaggtgctattggtcaaaaagttattaaaaatcttagcggttttgattgtaagattttagcttatgacccatttattaaagatgaaataaagaaatatgcacaatatgtatcattagatgaaatatttgaaaaaagtgatatcttaacatttcatgttcctgcaaccagtgatacatatcatattgtaagaaaagaaacaattgataaaatgaaagataatgttattatcattaatacagcaagaggcagtgtaataaataccaatgatttgattgaagcattagaaaaaggtaaaattggatcatgtgcattggatgtgattgaaaatgaattaggtttatattacgatgattataaatatgaaaatataggtaatcatgaattatctattttgcgtgatatgccaaatgttttacttacaccacatatggctttttatacagagcaggcagtaagtgatatggttgaacattcgattataagtattgtggcatcaaaagagggtaaggaaaataagtttagagtttgttaaaaaaattaattttgaataatttatgttttttgttacaaactattattggggtgataatattgaagaaaaacagaaaacaaactaaatcaaatgaaactcaaaaaactgcagttaataatcaatggacaaataataatacaaaatattatccagataatagggaacgtcaagatggcccaggtggtaattaagaaactttattaatttaaagtttcttttatttataacaaataagaattattttaccagctacaaaatctaataaattgctcaaaccggttggtagagtaagagtttaagggattcaaacaagaaattaataaaaatataatttggctggtaaaaaacagaaagttgttgatatatataggttttgaggtataatagaaaatgaaaagtggctaatttactaggggtttaataacaacataagatgtattgaaatttcacaattaaacttgctaaaacgaaccatcctactagtttaataacaacataagatgtattgaaatttaaatccaagtgttgacgatagttttaaaagagaagtttaataacaacataagatgtattgaaatatgcacgatactagagatacgtttgcaaccctctgcgtttaataacaacataagatgtattgaaataatacctctgcgcaacgttctgttgcagatttacaggtttaataacaacataagatgtattgaaattacttttgaactttaaaatcataaattccttcaggtttaataacaacataagatgtattgaaatagtctttcgttaatcttaagtacagcatattataaagtttaataacaacataagatgtattgaaatttaatatcaccgattccactataaaaaccaaatctgtttaataacaacataagatgtattgaaatttttttaatttgattgcctaaatggttgtactctccagtttaataacaacataagatgtattgaaataaaataaacatctagacatctaattttcctccgtatagtttaataacaacataagatgtattgaaatgaaacattaagaccaaaaacgatagcatggtaatggtttaataacaacataagatgtattgaaatccaataaacactctaataatagttttagcaagctctgtttaataacaacataagatgtattgaaatcccaaagccgtagtggtattggtacctgactgttggtttaataacaacataagatgtattgaaatgttgcgactatgggacgcagaatgcaacagtgttgtttaataacaacataagatgtattgaaatagagcagatgtctaacacgtctgctcaacgttccggtttaataacaacataagatgtattgaaatataacttgtgcagcataattacctgaaactggagtgtttaataacaacattagatgtataagattttttaacagtataactaatctacatactggagtttaatatcaacatgaaatgtataaaaacattaatattctaagataatattttaagaaaaagtgtaaaatgataacgttttcaataaaagtgtgataaaatatatgtattacagctaatgataaggataattctaagtcaaagggtggacgatattttattatgtttaaccattagtatgttttctaatggttttttatttaaggaggcaagatggatagtagaattgcgataattggtgtatttgtttatgaattagaaagtgcaaataaaattaataatcttttacatgagtatagtcaatatattattggacgtatgggaattccatataaagataagaaagtttctgttatttcggttattgtagatggtcctaatgatgttatcggagctcttactggtaagattggaatgattaaaggagttagtgttaaaacactatattcaaaagtataaaatgaataacattgaattgattgataaactaaatcatgaaggtgaattagattttgatgaatttaagcaattattatctacttataaccaagaggattttacttatgctaaagaaacagctgcaaaaattactaaacaaatatttagtaataaaatatatattagaggtttaatagaaattagcagctattgtaaaaatgattgttattattgtggacttagaaaaagcaatttaaatgctttacgctatcgactaagtaaagaagaaatattgcttagctgtaaagaaggttataaacttggctttcggacttttgtattacaaggtggggaagatttatattatcaggatgatttaatggttgatattattaaatcaattagaacattatatcctgattgtgcaattacgctatcacttggtgaaaaaagtaaagaaacttatcaaaaatattatgatgcaggtgctaatcgttatttattaagacatgaaacatataatgaagatcattactatatgttacaccctcaagaaatgtcatttaaacagcgaattgaatgtttgcatcatttaaaagaaattggttttcaaaccggatgtggattcatggtaggcagctaccatcaaacaatagatcacttagttaatgatttgttgtttattaaaaagcttaaaccagaaatggtcggaattggaccatatatggttcatcacgacacaccatttaaagatttgaaaaatggcgatttaaagctaactttatttttattgagtttaattagaattatgacaaaagatgttcttttaccttcaactacagctttagcaactcttgatccaaaaggacgaattgagggaatcaagcatggctgtaatgttgttatgcctaatttatcaccatatgaggttaggaaaaaatatttgttgtatgacaataaagcatcttctggacaagaggctagtgaaggacttaaggaattggttgatacattgagtaaagaaggttatgaaatagtgtatcagcgtggagattattgtaaatttgattacaaggggtaatacctgagtaaaagaaggagtaggaatatgtataatgtaaaatcaaataaggctgaagaatttattgatgatcaagaaattttagatacaattgaatatgcaaaagagaataaaaataatcgcgaattaattttttctttgattgaaagagcaaaagattgtaaaggattaaatcatcgtgaagcaatgttgctattagaatgtgagattcctgaagcaattgaagagatggaaaaagttgctaagatgatcaaagaaaaattatatggtaatcgaattgttatgtttgcacctttatacttatctaattattgtataaatggctgtgtttattgtccttatcatttaaaaaataaacatatcgcaagaaaaaaactaacgcaggaagaaataaaaaaagaagtaattgcgcttcaggatatgggacataagcgattagcattagaaactggagaagatccaataaataatccaattgaatatgttttagaaagtattaaaacaatttatagtattaaacataaaaacggagctattcgtcgtgtcaatgtcaatattgctgcaacaacagtagaaaactatcgaaaattaaaagaagcaggaatcggtacttatatccttttccaagaaacttataataagaaaaattatgaagctttgcatccaaccggaccaaaacatgattacgcttaccatacggaagcaatggatcgagctatggatggcggaattgatgatgtaggaattggtgttttatttggtttagaaatgtatcgttatgattttgttggcttattgatgcatgctgaacacttagaagcagcgaagggggttggaccacatactattagtgtgccaagaatttgtccagctgacgatatcgataaagatgattttagtaatgcaataagtgatgaaattttcgaaaagatcgttatgattattagaatggcagtaccatataccggaatgatcatctcaactcgggaatctaagaaagtacgggaacgtgtattacaattaggaatatcacaaatcagcggtggttcaaagacaagtgttgggggatatgtcgaaccagaaaaggaagatgaagtaacgtcagcccaatttgatattagtgataatcgcagtttggatgaagttgttaactggttatgttctttaggctttattcctagtttttgtacagcgtgctatcgcgaaggaagaactggtgatcgttttatgcagttatgtaagtctggtcaaatctctaattgttgtcatcctaatgctttgatgactttaaaagaatatttacaagattatgctagtgaagataccagagctaaagcagaagcattgattaaaaaggaattaaataatgttagcagtgataaagtcagaaaaatttgccaggaacgtttatcgatgattgaagaaggaaaacgggattttagattttaattatggcgggattaaatcaaacccctggcgcaaatcgtcttcatattggtttttttggtaaacgtaatagtggtaaatcttcattaataaatgcttttgtaaatcaggatgtttcaattgtttccagtcaagctggaacgactactgatcctgtttataaagctatggaaattcatggactgggaccatgtttattagttgatacagctggctttgatgatttaggagacttaggtaaacaaagaaatgataaaacaaaaaaagctagagaaaaaatagatattgcagttattctttttaatgacgaaaacatcgaccaggaattaacatggtataattattttaatgatcgtcatattcctgtaatattggtaattagtaaaatagatcaaggaatcaatgataatttaaataaatcaatttttgagcacacaaaaaaagaaccgcttttaattagtgctgttaccaagcagggaattttagaattaaaagaagctttgatcaataatttacctgcagatcatgaaaaagaaagtataactggcgatttagtaaaaagtggtgatttagttttattagttatgcctcaagatattcaggcgcctaaagggagactaattttaccacaggtacaagtattgcgggaattacttgataaaaaatgccaagtaatcgcagttactactgatcagctgttaaatgctttagctaatttaaataaagatcctgatttagttattactgattctcaggtatttaaatatgttgatgaaaatatatctaaacaaagtaaattaacgtcattttcagttttaatggcaggatataaaggtgatttaagatattatattgatagtgttaaaaaactagaagagttatctaatgaatctaatattttaattgctgagtgctgtagtcatgcgccattaagcgaagatattggccgcgtaaaaattcctagattattaaaaaagcgttatccgcaaataaatattgatgttgttagtggaacagattttccggatgatttaactaattatgatctaattattacttgtggcggctgtatgtttaatcgtcgttatattatgtcaagaattgatcgggctaaagcacaaggaattgcaatgactaattatggtatttttattgcttatgttaatgatattttaaagcgggtagtatattgataaataatcttaagttagatatagaactatatctaaaaagcctaatttcaatgattaggctttttaatttaaaaggaatgattattcaaaatatgaaacttttttaggatcataacggtcaattaatggtttatcttcgttactataacctaaagcaactaccccaactggatattcatgctcttttaaatgatagtaatttttaaaatttttaattctttgttcaacaggagcaatcccgcaccagcagctgccaagaccttgattgactgcctcaatcaacatattttcgatagctgcagcacaattgattaagccatattcaacatttttggctttgtctagattagctataactaaaatagcgcatggggcttcttgcatcatagccatgtagcaggaaaggttgaccatattatttagtgctgttctattagtaataactttaaattcccattcttgactatttctagcagttggagcattcattgcggcttttaaaatttctgtaattttctctttttcaacagcagtatctttatattttcgaatactttgccgcttttcaatttcttttaacatttcaaatacctcctgaaatcattatagctcaggaatataaaatatttaagataaaactgttataatatgatgttagtttatgatatagtagttttgaggtgagattatgttaaaggtgcaacatgctaataaggtggtaaaaggaccatatcgctgtcttgttattagtgatattcatagtcatttagatttgttgaaacaattattaaagaaagtacattattgtcaagatgattatttaataattgtgggagactttgttgaaaaaggtacccaaacaattgaaacgatcgaatatttaatgactctgcaaagccaaagtgatcgcgtatatgtattacttggtaactgtgaatatgcagttgaagagatggtttcaaatcctaaattagctaaacaagtaattaattacttgaatcgtattggtaaaggcggaatgattcgccaagcaataaagaaactctcattagatataaaaacagatcagcctgaagagattcaaagaaaaataaaagtgtttttacaaccttattttgattattttgcaactctttatacaaccttaaaatttaatgattttatttttgttcacgcaggaattgaaaaaagaaaagactggtggaattcaaaacttacttcaatgattgaaatgcagacattttaccgtgatggtcattgtttaaataattatgttatagtaggacatttaccagtttctaatcaatatcgtaatgccatcaacaataatattatcattgataatgataaaaagatcattagcattgatggtggtattggagtaaaatcaattagtcagctcaatgtattaataataaatggtgatggagataaatttagttttgataaagaatatgttcagcccttaccacaatatgaagtcttagtagatataaaaacatcacctgaagaaccagtaaaaatttcctggccgcattttgaagttgaattattaaaaagaaacaggaatttttccaagtgtaaacaattagatacaaataatattttagatataaaaaacgaatttctatactatcgaaatgataagctttattgtttagatgattatatcgatcatcggatatctttaaataaaggagatgtcgttaaggtaattggagtatatgatatatatgcctatattatttatggtgaagaagttggttgggtgaagtatcgctatttaagaaaaatatgattttagatagatcaaatcttttgcattttatgtaaaagatttttattttatgcttataattatagaagatgacctttaatgatatatgcttaatgatcgatgtagaaaaatgtagggaaagttagaatagtctgttataatggaaaatgcaggaaatgtttttaaattaaaacagtttaaaaagttatttaattttcttgtaaaaagtattatcgatttatggaggttatttatgacaaaatcaaaaaaaatcgtttggtataatttagcctttatggcattttcaaccgtatggggatttggaaatgttgttaacggttttgtatactttaatggtatccaggttatttttagctggatcatgatgtttgctctatattttgtaccatatgctttaatggttggagaattagggtcagcatttaaaaacgctggtggtggcgttagttcatggatacatgaaacaatgggaccaaaacttgcatattatgcagggtggacatactgggtcgttcatatgccatatattgcatctaaagcatctggaggactaaaagctttaagttgggttctttttcaaaattcaacattttatgattcattagatataagattagttcaaatcattacccttattgtctttttattttttgcatgggtagcttcacgaggtttgaatccattaaaatcattagctactttagccggatcatcaatgtttgtgatgtcaattttatttattatcttgatgatagcagccccagtacttaatcctgatggtggttatcaaacaatggactggagttttaaaaacttaattccatcatttagattagagtattttacgtcattatctattttagtttttgcagttggcggctgtgaaaaaatatccccatatgtaaacaaagtagagaatccttcaaaaggttttcctaaaggaatgatcacgctggcaatcatggttattgtttgtgcaattttgggaacaatatcaatggggatgatgtttaatgtggctgatattaatgctaattttgattcatatgtagcaaatggagcatattggtcatttcaaaaattaggtgagtattatggtaatggtaatactttcttaattatttatgctatttgcaatatgattggtcaattatcaacattagttatttctattgatgcgccacttagaatgttattggataatgaagatgcaagacaatttatcccttcaaaattattgaagaaaaataaaaatggtgcttacgtaaatggtatctggctggtagttgtcatcgttacaccattgattttagtaccggcaatgggaattaaaagtgttacttcatttttgaaatttttaactcaattaaattcagtttgtatgccactacgttatttatgggtatttattgcttatatcgctttacgtaaagcaattgataaatttccagctgaatatcgttttaccaaaaatcaaatattagcaaaattctttggctggtggtgttttgtggttaccgcagtttgttgtggtctaggaatgtttaaaggaacaccttttgaaattgcgatgaatattattacaccaattattttagttggtttaggagcaattatgcctgcactggcaaaacgtaataaatcaaattaatataaacatatcctttaacaaactgttaaaggatatgttataattggcaaagaatgaggaggacatgctgatggataaaaaaatatctcaagaattaatggcttttataaaacagagtcctacagcatttcacgctgtagataacatgaaaaaaatgttaaaagaaaatgattatgaagaattattagaaggacaggcttggaaaattaaacctggtaaacgatattttgtatcaagaaataattcaagtatcatcgcttttaatttaggatcaaaattagataaatatagtttcaatgtagctgcttcacatagtgattcaccaacatttaaaatcaaggaaaatgctgaaattgaaatcaaaggaaaatatacacagttaaatactgaaggttatggtggaatgttgtgtgctacctggtttgatcgaccattatcaattgccggaagagtgttgattcaagaaggtaatagctatattacgaaacttgttaatatcgatcgtgatttagtgatgattcctaatgttgcaattcatatgaatcgtgcagtaaatgatggttttgcttataataaacaaattgatatgctgccattatttggtggaagtgatagtaaagctggtgatttaaaacatttaattgctgagcaattaaatgttgccgatgaaaatatctatgggatggatctatatctatataatcgtatggaaccatctatttggggtgttaatgaggaatttatctcatgttcacaattagatgacttacaatgtgcgtatgcttctttacaaggatttttaaaaggaagcaatgaccagtctattaatgtttttgcttgttttgataatgaagaagtaggttcgggaacaaaacaaggggcaggctcaacattcttatacgatattttaaaacgtgtgaataatgcgttagggaaaaatgatgaagaattttatcaggcattagcttctagttttatgttaagcgctgataatgctcatgcagttcatcccaatcatcctgaaaaaacagatgttaataattgtgtgtatttaaatgaaggtgttgtagttaaatcgcatgcgggacaaaaatatacgagtgatgctcttagtatagctgtgtttaaaggcttatgtaaaaaagctaatgtgccagtacaattttttgcgaatcgttcggatgctttaggaggcagtacgttaggaaatatagctatggctcaagtttctatgaattgtgttgatattggattaccacaattagcaatgcattcttcatatgaaacaacaggaatcaaagatacatattatatgatcaaagttatggaagaattctttaatagtcatatcgaagaaacaagtgcacatgaattaaaggttactaagtaatgcgaaaaaataatttaaagaaggaagtacttgaaaaatatgtaatatcaggattatggcagacgatgtgtggttatatagttttattatttataaaagaactattaacaaacaattatttaattaacttttctattgatgtgttagttgcaattattgctttttatatagcattgaataatttgattaatcaatataaattaattaaagagaacgatatttcaatgaaaccattttattttcaaatctttggttttatcttggggttatttatatctattatgactttaaaaactccttttgatatttcttttgtaattcttgtagttacttttataacaaataataaaatgtttgaaaatgaattaagttagaaactttattaatttaaagtttcttttatttttacttataacaaataggaattattttaccagctacaaaatctaataaattgctcaaaccggttggtagagtaggagtttaagaaattcaaacaagaaattaataaaaatataatttggctggtaaaaaaatagaaagttgttgatatatataggttttagggtataatagaaaatggaaagtggctaatttactagggtttaataacaacataagatgtattgaaatgaacgacagacagattagaacacaaaaaagaagcttgtttaataacaacataagatgtattgaaataaattactaaaatataccgctttccaatctttaacgtttaataacaacataagatgtattgaaatctttattgttatataatatttttataaaatgcttagtttaataacaacataagatgtattgaaatattggtacgacattaccgtctgtatcgattaccattggtttaataacaacataagatgtattgaaatttaaatgtatctccaagcgttgttaacgatctaacaagtttaataacaacataagatgtattgaaatagaacttggtgtcggaataattgaagctcatcagggtttaataacaacataagatgtattgaaatactatttcaggaacgtaaactccatcttcgtcaagtttaataacaacataagatgtattgaaatatggtaaaaagaacgtttatatttatgcttccagcgggtttaataacaacataagatgtattgaaatatttttcaattttaggtatccttttttccatttttttgtttaataacaacataagatgtattgaaatggagatttatacagatttttcttataatttcgataagtttaataacaacataagatgtattgaaattaaagtcaagtgcgtttatcagatcttcgatgtcgtttaataacaacataagatgtattgaaatcctacaaatctgtaatgatcttgagatgatcttttacgtttaataacaacataagatgtattgaaattcatttgccttttttgagaaatccttacgttctacatgtttaataacaacataagatgtattgaaatttcctactagcccggtagtgtcccctgttaaattaagtttaataacaacataagatgtattgaaattcgaacaatttgataaactctcgatttcaatctcgcgtttaataacaacataagatgtattgaaatactggtttaaatgatcgaatatccattaacggtatcgtttaataacaacataagatgtattgaaattactttttttaccttctttctagctgagttttatgtttaataacaacataagatgtattgaaatgataaaatgttagataatgtatattctaatctgtcgtttaataacaacataagatgtattgaaattttgccatattcatgtgctgttgattagcgaattatattagataacttttttcagattaaattagttatttttgaaatgcttttttataaattaattataatgatcaaattattttaaccactttcttcaaattattttattataaatattataaaaacagtctgattgatatttttataatatcaatcagactgtcatttctactatatttctatatcaaatattgtttcagatttttcttcacatcctgataatatttttaaatatcctgctatatcactaagtctttcttctatactgcttagtaccctgtatagttcaatttcaaaacacccatccttaggaacgtacttttcttttagatattctgccagttctataaaatcttctgcattcatcttatctctctcctcatttaaaaaaattatcgataattttaagcccattggctatagttagaccatctattatactgctggtatgttctgccagcttttcactgttccagaagatatcatcaagacagctcagttcacttgagatccccatctctggaatatccagccatcttgttttaccgaattctatcagatacacacgataaagactcccttttccacttactgtaaatcccgttatctgctttgtttgttcgatatcttttattctgcatttccatctcatatttttatagctgcattcatatatcagttcttttttatccgatttcatctgctgcctccattaccgtatcattatcgatcatcatcctgtttgctgctgctccaactatcaaacagtgtgtcatcagattgtttagttttcttgatgaaccctgacaggcatttgacagcgccgtcaatgcttccggcatgaccagcggttcattccttccggctttttttaattttatctttatataattttcaatatctttctcattgatcccggttgtttcatactgaatcacgatcctttgcctgagtgcttcatgaactgctctattgaccgtatgatttaatactggtgttcctgtcagaatcagaatcacataactgctcgaatcaaaattaaaattcaaaagcattatcagatcgttcagaatctctgttttcaaaaattgaccctcatctaatattatgaccggcacgatccttttctcatcgaccatcttttttatatgtgcctggatatttctgaaattatctatttttttatgatatatttccagtcccagctgatggctcagttcacgatagaattcgatcgtgctcagtgttgacattggcatatatattactttatatagaccaggattcagtgtttcactgaattttttcattataaacgatttgcctgtcccgcttcggccggtaaacaatcctatccctctgacaccttttagataatcgagccttcccatagcttcctgataatcaccggtatctaccggtatatcaggctgtcccttttcaaatggattgaattcaagtccataatagatcttaaaatctttcattggtcatcctcctttgaaaacagcggtcgctttctttttattctggaattgtctactttttttacttcagagatctttatataacttttatcatcaaatatataaacttcactaagatcaggtttatatttgatagttattttgctgcctatatactcctgttttgtctcgtaaacttttgtattgagtctgatcgttgcatcattggcaacttttctgactgcagtatgataaaatattttttcaagcttctctggttcgacccttctgatcgatgtttcatcatccataaaaacatttactggagtgtttccattcagtgaagcatgtggtgaattgtttttcttattgacatatagggcaaaagctgaatctatatcttcgatacttttgaactgattaaaatcagtattgtacatccactgctcttttactgatttaaaggctctttccacttttcccttagaattgccatggaatacctgagcatgattgatctggatctgcagctgagcgcagatgatcggtaactgttcgtttttgtatggttttccattatcggcatacagtctttttggaacaccatatttagctattgcccgtttcagtactgtctggacattgacagcgttgtcttcaagtgttattcggtggattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatggtcctatgtcaagatttcggactaactaaatgtaagaaaattagttagtttcctctaacatgtatttgctctcatattcatttggtgataaatattcacaatgtgagtggattcttactgtattatagaatccttctaaatattcaaacaccagctgatatgcctgatgataattcattatcttaaatctgtttagccactctctttttattaatgcgtgatatgattctatacatgcattatcccatggattaccttttcttgaatagctgcacaccatatcccttgtcagctctcgatacctcctcgatgtgtaatgtattcccctgtcactttgtattactactggattggctgtttttcttctgctctttgctgtttccagacattttaatacctcatccacctccagtgttttacttaatgtccaggctattatttttcttgaatataaatccattatactggttagatatacaaatccttcatcatgtgtgtatatataagttatgtctgtacaccatgcttcatttggcgcctttggattaaaatctctttttagaatattatgtaatctgctggaaaagtcacagtcttttgttgttttagtatatggcttgatatagtgggctttaatgttgttttctttcattagtttccctacaaatctttcactaaccttatgtccttctctttgaagtatctgggttattttaggtgctccatatatttcttttgattccttgtgtatttccttgattctaacagctagtttagctcttcttattttttgattacatggttttcttttaaggtagtcataatatccagatttactgatattcaatttttcaagcatactggtaactgaagctttaggatcagcgtcagattttttcttgatctgatcatacagttcctgcttagttaattccccagtatgccaatagccttttttaggacatctaaagcatcctttgtatccttaagttctttttttagtttggcaatttctttagcttcatcactggaatagttgccactgcccctggaattaattgtaccattattatttttagcatctttaagccacttgtgaacagtactgtcagcaacaccaaagtgtttggcaatagcgaccttggattcatcagggtgctgcagtacatagtcaacaactccctgtttaaattcatctgtaaatgttggtttactcataatcatatacctctttcatttcttataattaactcatgacattgtaccacaggactgctaattcttccatttaactggtacagtttttattctagcaccagtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaatagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacactccatcctcaatgagcttcaaataaacagaagttgctgtcatccttggattcgtttttttcatttccatgattttgtttttcaaagttttattcagttttcttgaatgtcctttgtcgctgcggttttttggcatcagtccactaaatccttctttttgatatgtatcataccagtatcgtatcgtttgaaatgaatattctcttgatgtaccatcaggatacttcaatggattggacgcgatccttttataatactgcagcgccgaacgatctggataggttctgttaagaactggtactatcagttcatatctaaaaagtgcgatcttagtatccagatcatcttttttactgttattcatataaaatacacctcctgacctaaacatataacagccggaagaaatattcaaagtaacagttatgggaaaataagtttatatataaattgtcatattgttgactgaaatacgctgcataaacatggtgtgatattcgtaaaagtaattcagtataaaatcaaagtcataaaaatcagatactctaaaaacactcaaaaatgaatcgagtcttttctgatggaagcggatataaaacctgatgactttttttactgtttctctggaaaaaccggttatttttgaaataacagaacatgaatgcgtgatattgcgataagacttgattattctgattatcgatggatttgataatattcgatagggaataatgatactgggaagaagagcgtgtgtgcaaccgcagctttcgcatttgatcctaacgatagaaatcagcagcgtatggttggaatcaatagccagataacgctgatagcaggcatgacgatgaaaatgtccagtagaaccgcaggtacatttaaatttattaagatctaatgatcttacatcattatcataagagttttgagaataattattgaaagaaagtgttttaaatgttatcattgatgtgtacaagacatacataatgttttggggaaaaagagaggtaggactgcaatccaaggttcttactcgcttatgggtaaatgaacttattagacagcacaagaaattgtgctgtttttctttagtttgtatttcttgtttttgggcattttgatacaatatatgtatggatggtgatacatatgaaatataatgaaatcagtttgaatgaaaaaatctttggtaatgacttcattgtctatgactggaaagaatcagataataaaatcataatatatgttgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactattccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaggttcttactcgcttatgggtaaatgaacttattagacagcacaagaaattgtgctgtttttctttagtttgtatttcttgtttttgggcattttgatacaatatatgtatggatggtgatacatatgaaatataatgaaatcagtttgaatgaaaaaatctttggtaatgacttcattgtctatgactggaaagaatcagataataaaatcataatatatgtgaaagcgacttctcatgatgatgtatgtcctgtatgtggttctcctacaagttctttacataatacctatcatagaatgattcaggcttatcctgttagaaataaaacaacttttattgatgtgattgcttataaatatgactgtactaatgacaaatgcaatagaaaggttattatgcagaatcttccttttgtttctccctctcaaagaagaacagatgagcttaactgtcttatccttgcagtttctctctttttaagcaatgaaggtgccagtaaagtactgaaacttcttggggtcaatataagcaatgactctatcaaacgcctgactgataagatcattattgaagatgaccctgatgtcgagtctattggaatagatgatgtggcgatgagaaaaggaaaggcttatgcaactgccatatatgatatggaagatcatcatcttattgcgcttttagatggaagagataaggaaacagttgttgaatggctaaaaaatcatcaaaaaataaagattgccacacgtgacagagcaagtgcatacgcttctgcaatcagtgaagttttacctgaatgtatccagattgcagacagatttcatcttcttcaaaatttaattgacagaataaaagatatttttaaaacggaaataccggaaacagtattcataaaagatggaaaggtactggaagaggaacctcaaaaggttccagcattaaaaatcgatccaaattcaaaggaacttgaaaaatatgactatgacaacagtatgccagttgataaagaaggaaatatgattgattttgatgcggtatgttatgataaaaacgataaacaacacagacagcaggctgaaagccgtaaaaaaaacagaaaatgatcattgacattcaaaaaagatgggaggaactcgaaaaaaagaaatacacaacaatagctaaagaattttcaatatcaaatattgtagctaaaaaatatgtaaatatgagtgaagaggatattcaattgttggacagtccaaagaaatacaaacaaagaaaaacagctacagatgactatatcaatatgatctataaaatgatcctggatggaataaagccagaaataatctttagctatgtcattatgaaaggatataaaggtacgtggaagtcattggataacagaattgtatacttattaaaaaataattttagtatttctctttcaatggggtggtatattaagtataaatatccagataatatcatcatcataaaaagaaatgaaatattaaaatacataacaactaaaaatgagaaaacaaagaaaaataaaacagttgaaaaaaacattcaaataatcaaggaaagatatccaattataactgaactagaaaaaatatatgattcgttttacagcacgatcaaggaggcagatactgatcagctagataagtttattgataattatagagaatcagtattaaaaggatttatagaaggtatagaaaaagatattgccccgatcaagaacgcaatatcttatccatatagttcgggatttgttgaaggaaacaacaacaaattcaaactcatcaaacgtattttatatggaagaagtaaaatagtcaatctttttaggaaatgttacataccatttttaatgaataataaagattttaagctaattgatattttagaacacaaaaacagcacaatttcttgtgctgtctaataagttcatttacccataagcgagtaagaaccgcaatccaatgatcctttcttttttatatgccgatctccttaaacataataataaaacagttgagataatttgcatattaatttatcaaattatttcagctgttttttatatttattaatttaatttgatttgttcctgtctttttttgtttatataatgtgctaatcaacaatgtgcttagctagccagtcgattgtttaataacaacataagatgtattgaaatggatagagcgcgtgaaaaaggtcaatcatcggctgcgtttaataacgacataagatgtattgaaattattcttcaagaaaatctttaacaaacgatgttggtttaataacaacataagatgtattgaaatgaacttatacctaaatcatgagttatcttttcccaaagtttaataacaacataagatgtattgaaatttttggtcttccataacaaaatattctcccgtgttagtttaataacaacataagatgtattgaaatccgattggaattaattcttttactaacaataaaaagtttaataacaacataagatgtattgaaatctgatttcagtaataacaccacaacagaatttgattaatcaatctcggttgattaaagaaaatgatattttgataaaatcattttttagatctttggacttttggtaggattatttattgtaattatgactctaaaataatccttttgatattttttgtaattcttgtagttacttttataattagtaaaaagatatttgaaaaagaattaacctagaaactttatttcattaaagttttattttttttggatattaaattattgttttaataatcattgacaaatttatgtaagcgctttatcatattattaatatagaagttttacaattatatcttaattaagatatcagctttctatgatgtcttttttaaatataattaaaactctatgtggggaaagaatattaaagaaagtgaggatttttatgaaaaaactattttctgtgctgctggtaatgacaatgttattttccgtcatgacaccattatcagttcagggaaaagaatttgaaagtacagttattagtgatctttcaattcaaggattacgggatgtaaaaaatttggaagtagatacaaagacccatgtatttgtaactacatatccagaagaaggcgtagaattattggttgattctaaagattcatcaatagctgaggtatctttagaagaaaatgcaatagttgtacaagctaaaaaagctggaactacaacaatagaagtaactgcaaaaaaagacggtaaaatagaaaatggacaatttaatgttcaagtaattgagccagtatataaacaaactgctcatacagaagtaaatattaatgacaatgactggcggtttaaattagaaaaagatatggaaaaagtacctgacagtcaaacggttcctactattgataataattgggaacatgtacaagtaccacattgctggaacagtgaagatggtgctgatggtaataatgattatgttaaaggtaaaggatggtatatcactgatgtagattttacaagtaatacttatgaaaataaaaatgtatttttagaagtacagggtgcttgtaagattactgacgtatatgtagacggaaaatatcttggtcagcatgaaggtggatattctaattttagatttgatattactgattatgtaaaaaaagatggtttaacgcaaatagcgttatgtgtagataaccgagttaattcattaatgcctttgtcaggagattttacagtatttggtggtttataccgtgatgttaatattattgctgttgatgatagtcattttgatttattagatcatggaagtgaaggggtcttaattaaccaggcagtaattgataatgtcactaaagattctacagttacagatgtttttggtgctggtggtaagattaatattgatgctagagttgctgttaataacgaggaaaaggcatatatgcaaacagttgtgtatgatgcaaattgggatgaagtttctcgaaatgaaaaaattgaaattaacggtactggcgaaatccaaaatgtaaatgaacaaatcatcgtagatgatcctcatttatggaatggggttaaagatccatatttatataatgtaaaagtgttcttatacgatgaaaataatgatatcaaagatgttgtatataaaaaaattggttttagattttattatgttgatgaaaatgaaggatttttcttaaatggtgaatcatatccattacgtggtgtaaataagcatcaggaccgcatggataaaggatatgcagttagtaaaaaagaccaggaagaagatatggcaatgattgcagatattggtgctaatgctttgcgtttggctcattatcaacatgatgaatatgcttatgaattagctgatatatacggtatctgtgcatgggcagaaattccgttagttaatagtatgacagcaagtgaacattttactgaaagtacaaaaaataatttagaggaattaataaagcaaaatatatctcatccatcgatcgttgtatggggaattcataatgaacaatggccaaataatggtggaaggataaatacgctcttacgtgatttatatgaattatctcatgaattagataattcgcgtttagttactgtagcgacagcacaaagtcaaagtgctgctttaagctggcagtctgatgttagtgcatggaataaatattttggtttatacgaatcacaggatgtacgttattttggaacttggcttgatcaagtaaaagaatatgctcagagtcatgatactattgatgttaccgatgaaagtactggtgagacaattaccgttaatgtaaatggaaaaattggaatgagtgaatacggggttggaagtaatgttgaatatcatgaagaaaatcctggatatcgagtaggaactagctttgatgcttatcaaaccgaagaattccaagcacagtggcacgaaatctattatcaggcaatagaagagcggccatggttgtggggaacttttgtatggaacatgtttgagtttggttctgatagtcgcagtgaagctggtagaaaaggaattaataacaaaggaatggtttcatatgaccgtactttgaaaaaagatgtatattatttttatcgggctacctggtcaaaagatccaactttacatatcacaagtaaaagatttgaaaatcgttatcaggatgttatttcaacaaaagtatatgctaatatggatgaagttgaattgattgtaaatggtgtttctcagggtattgtaacagcaagtgaagttgaacagcataaatttatgtgggatataactttacaatcaggtgaaaatcatattgttgcaattggtagaaaagacggtaaaacatatgttgatgaaacaacatggaatcgaaaattatacgatacagtttcaatctcttcaaatttatataattttgcatatgtaaatgatgaaaatagtactgtttcaggaattccggcgggaactaaagtacaagactttaaagcaaatgtaactttatcaaatggtactagtgttgaagtttatgatagtgataagagtactttattagatgatgatatatcgattagctacgatatgtggatcaaagcaatcagtgaagatcaagaacatgcggtttggtatagagtaatcgttcagccaatatcacgaaataagccagtaatcgtagaaaatgaaaaaagtggcgaaccaaaagaaaatatggttgatggtaaaacagatacggcatggaattcaggaatagctttatctacacagtcaccacaaaatgcaattattgatttacaagatacttattatgtttatgatactaatgtattatggtgggatcatgacactagtcatcgtacatttacatattcggtttatttaagccaggataatgtaaattggactaaagttattgattcaactaagagtagtgatcaaagcagtggaatgagctggtctaatcgtaattttgaaccacaactagctcgatatgtaaaaattgaaggactttcggcaactaattcagtagcctcaatgtatattcgtgaagttgaagtacatggttttatgttaaagagtgatatctatcgcattgataatgccaatgctaaaataaaaggctggtcaggtgataatgttgaagatttattaggaaatctaatagttgatggaaactttgataagatttcgatcattgatcaagatggtaatactgttagtagtggtgaacttgatgctaagatgaaagttgttattagcacaggagatgaagaaattatttatgctctagaaaagagcggtttagatactacgccagtttcacaaaacaaaaaagtaattgcttttgaaggtgtagatagtgatggtgtaactaaacctaatgaagatgttttagaaggcgaaaatgatcttgttcatggtaagaattatgcacctgctcattatattaacgatggcaaacttgatacaagatggagcggtgcgatgaatgctgctcatgataaagcaatttatcctgctaaagtatgcattgatttaggggctgattatcatttaaatcatatagatttaactttctatggtggaacgacgccacataatgaaaataatgtaaatcgttattatacatataaaatctatgctgcagataacttagatgttttacagcaagaaacaattgatgaaaaatatttaattgttgatggtagtgataatattgagaaaaaagaaaatcatgtaatagaagatttaaatgctaagggacgatatgttctattagaaattgatggtaaaagcacaagttatgcataccatgctccgagtgtttgggagatggaaatagaaggttatcaaataaattcagcagtatataatgttgatgaaagtaatcatattattagtggtttaagtattggaactacggtagcagaattattgaatcaattagaaattgatggaaatgcaaaaataagtgttgttgatggtaataatgagttagatgatcaagatgttatttatgaaggtgtttctttaattattgaaagtttaaatcaagaaattaaagatacctatactttatcatttgctgatcatagtactactccaatatctcaaaatcagccggtacaggcattagttaccgaagaagaggtagatggtaagatcgtcgctaatgaagatgcggctaaaggttttgttgttactaatatcaatgatggtaatatcgatacaagatggagtggagtaatgaatgcagctcgaactcaaagctattatccagcaacagttcatatagaccttactgaaaaagcagatacaaatgattggttctatcttactggagttacgattgactggtttaattcagcttcaaaacgctcttatcaatatgaattacatgccttgaatccagtaggaatagctggtggttatgatctagttaataatgataatacaattcaggatcatacagagcattgggttgaaggaaaaacatcacaaattaaagatatgaatttaacagtaaatagttctagcttacagctagcatacattccagctgttgtaaaagaaataaaagtatttggttggcgacttggaggaaatattgttgatgaaagtaatgcaacagttaaacttgatgatacttcaattagtgtcgctaagcttatagctatgctgcaaccaaaaggaaattgtactgtagaaattcaaactaatgaaggaattataaaaaatagtaatgatatagttactcgaaacgataaagttgttgtaaaagatattcgtgatcaagaatttatttatacaattaaatcagctgttgatttagatttttctaagttacaacagttattagatatttgtgatcaattacaagaaaatgattatactgaagaaagctggttagaatttgttgaaatacgccaagaagctagaacagttttagaaaatgctgttagccaaaatgatattgatagtgctattgaaaaattacagcttgcaaaagataacttagtagaaaaagaaattataactactgataaatttgcattatcgatagctgttgaaatggcaaataatgtaactgaagaacagttagctaatgtcgttccagctgtcgttaatgaatttaaagcagcactacaagaagcaacagtaatcttagctgatgatagtgccagtcaggaaactatcaatgcttcatttgcccgcttatcagttgcgatgcagatgttgggatttgtaaaaggtgataagagtgctttagaagctttgatcaatgaagctaatagttatgcagaagaaaactatacagttacttcatggacagcatttaaagaagccttagaagcagctaatgcggtagtaaatgatgaaaatgcaatgcaggaagaagtagatgctgcttatgctgatttacaaacagcaatcaataacttagaaacagtagctcaagctgataagacattattagaaggactagtaaatcatattctaggactagataaagataagtatgttgaagaatcatggaatgcgatggtaccggtgttacaagaagcacaggatgttttagcagatcaaaaagcaagccaaagcgaagtagataaagtatatatcgaattagtaacagcattcttgaatttaagattcaaaccagtagaagaggtagataaaactgagttagaagcattaataaaagaagcagaaggctatgatgaagaagaatatacaccaagtacatggaatgtattacaggaagccttagatgcagctaaagaagtaatggcaaatgaaaatgctacagaagctgaagtagaaaaagcagttaatgatttacaagaagcaatcaacggtttaacaaagaaagccgataaagaattcttagaagagttgatcgatgaagtagaaggatataatgaagaagactatacaacaggatcgtgggcagtattccagaaagctttagaagcagcaaaagaagtattggcaaatgaagaagctacagaagcagaagtaatcgatgcatacaataatttaatcgatgcagtagaaaacttaatcttaagagcagataagacattactacagggaatgtatgataggtgtgaaggattagataagagtaaatatacagaagcaagtgttacaaacttagcagaaccaatggcaaaagctaaagcagtattagatgatccaaatgtaacacaagatgaggtagataatgcatattatggattattgaaagcatatttagatttgcggttgatcccaaataaagaattgttgacaggaacgattgctaaagcgatggagctaaataaagtaaattatagtgcaaagacatgggcagtagtagaagaagcgctagaaaaagctaaagcagtagcaaatgatcctgaagcagtgcaaagtgaagtggataaagctaaggatactttaacaaaagcaatcgaagggttagaaagtacatcagttgtaaaaacaggagatacaacaagtgtcgctactggtgataatactaatctaacagcagtattagggacagctgtttcattaagtgcaattgcgtatttatctagaaagaaaaagcaatgaaaataaaaagatttatctagttcttactcgataattaaaaataaggaagaattgaaatttatcgataattttgactcttccttttatatttttattaaaaaacaagaaagagcctatttttagatagatttttttgatatctttaagcgagaatataaaagattgagaaaaatattattgacctaaagttaactttaaggattataataattatatataataagtaagaatacgaggagtggtgaaagtggaaaaagcaaaagtatattttacaaaagagattacccctgaggcaatgatcaaaatgtatgaaatattaaaagttgaactttctggaaaagtggctgtaaaagttcattctggtgaagttggtaaccaaaattttattaaacctgattttatggaaccaataattaaatatgtaaatgggacgattgttgaatgtaatacagcgtacgaagggaaaagaaatacaactaaggaacattgggaaacgatgaaattacatggctggtgtgatattgcaagtgttgatattctagatgaagatggagaaatggaattaccagtaaaaaaaggttatcatttaaaagtaaattatgttggtgatcatttaaaaaattatgattctatgttagtattaagtcattttaaagggcatccaatgggtggctttggtggtgcattaaaaaatatttccattggaattgcttcgtcacatggtaaagctcatattcatggtgcaggtgttcctgaagaaatttggactgctgatcatgattcatttttagaatcaatggctgatgcagctcaaacaattgttaattattatcaagaaaatattgtttttataaatgttatgtgtaatatgtcagttgattgtgattgctgtgcagtggctgaagatcctgcaattgctgatattggaatcctttgttcaactgatccagtggcgttagatcaagcttgtttagatttagtttatgcatcaaatgatcctggtaaacaacatttattagaacgaatcgagtcaagaaatggtgtgcatacagttgaagctgctgcagctttaaaaattggtagtcgtgaatatgaattaattgatattgatcaaaataaatagacagctagtaaagttgtctatttttataaataaaaggaactgttattaacagtcccaaattattaattttcaattggttcaaaatcagcaacaccatgtttacataatgggcaaatataatcatcaggtaatgtatcaccttcataaacaaaaccacatactttacatacaaatccttttttaccttcagtattaggtttaggtttaacattatcttgataataagtatagctcattgtttctttatcagacataacacgtgcttcagttactttacaaatgaacataccatgagtttctaaatcaacatagttttcaacctcaagtgacataaacgcattaatataacgaggtaaaaaagcaagtccgttatcagagtataaaggtttaaaatcagcaaatttatctgttgttcgaccacttttaaaaccaaaacgttcaaaaacattaaatggtgcatccactgataaacagtttacgtttaatttacctgtttgtttgatcacatgatgtgaatagttttgtttattgatatttacagctacacgatttggagaatcactaacttgagtaacagtattaacaattaaaccattatctttttttccatcattacttgtaactacatacaaaccataaccaattctaaataatgcactcatatcatgtttatttgctttttcatcagattgtgcaatatagtcacggcataattcttcagataacttatcaattgcttcgatagtatcagctttaactgcagatttaacagttactgaattatcgctataagtaatttttttacatcctgatagcatttctttcatcacttttattgcaagtggtgaccaagaaccgttttcaataaatgcaacagtacgattttggaagtttctttcagttaagtgatggatatattctttcataaaagggaatacatcagcattatatgtagtcgttgctaaaactaatttaccataacgaaaagcattctcaacagctttagccatatcatcacgtgctaaatcatgaataataaccttcgggcatcctttttcttctaattttccagctaaaatttcaacagcttttttagtatttccataaactgaagtataggcaattacaattccttcactttcaatattatatgaagaccagatatcatataaattaatatagtaacctaaattttcagtcaatacgggaccgtgaagtggacaaattatttgaatatctagaccagcagccttttttaataatgcttgtacttgagcaccatattttccaacaattccaatataataacggcgtgcttcatcagcccattcttctttaacatcatttgctccaaattttccaaatccatcagcagagaataaaactttatcttttgcatcataagtaaccattacttctggccaatgtaccattggtgcaaatacaaatgttaaagtatgttcacctaaacatagagttgctccattttttacttcaagtctttttacagatgaatctaaatcaaaaaactgatccatcatagcaaatgtttttgcattagcaacaattgtagtatcaggatatattttaataaaatttttaatgtttgcagaatgatctggttccatatgctgaacaatcaaataatctggagttttatcatttaaaacatcagctagattatctagccattcatgagtaaaattaatatctacagtatccattactgcaattttttcatccataattacatatgaattatatgccattccattaggaacaacatattgtccttcaaataaatcgacattatgatcgttaacacctacataacgaatatcttttgaaatttccatagttctctccttaccttatttaataatcattaaaattatagtacattactattctaaaatcaacgaattagctttgtatattaaggaataaaaatcgatattatttttagaaatattttaaaaataaaaaaaatatccaaaaatcaataaagatagctcttggaatcgaaaataatgattaaaatttaaatccatgatataatatccctcataagaaaacaaataataaatgaaggcaggtaagatgatatgagacgaagtgatagagaaataacagatatcaaagaaataatcaaagtgatggaaaaatgtgatgtatgcagattagcgttgaacgatgaaggatatccttatattttgccacttaattttgggatgcaggtaaaagatgataagatcactctttatttccatggcgcaactgagggaagaaaatatgcattgattgccaaagataatcgagtgagttttgaaatggattgctcacatagattggtgatggatgtagatcagggtaattgtacaatggaatatgaaagtgttattggtaaagggaaaatagagatactttcagaagaagaaaaatatgaggctttatgcattttaatgaaacattatcatcaagaagattttcaatttaatctggcagtaatgcctaaaacaacagtaatgaaactagtcgttgaaaatgttacaggtaagatacggatgaagaaaaagaataaattttaattacgataaatttataaaagtagaatatattcttttataggatatttttgttattactaatttgattataagtagtttttatcgttcaaaataatcgatacaactatcatgcttaactaatcataatagttaacatgattgtttttatatttagaaaatttcataaaatattttattttttaacaggagttatttttcaaaatctatttgtaccagttttttttcattaggcaatagatactccagagttttgataggatgataaccgatttcatacattgtgttttttaatacgtgttcttccatttgatgatgtatctgctccaaatcgtcaaatacatgaagataaggagagtcagacacccagttattttctatattgatttgaataatgcatgaaacatattttggatctacctgcttgattgctttttgaaaacattcatatccaatatactcaatcaacagatttgcaataaccatatctgcttttggtaacttatcagtttcgtctatcaaattaatacacagacattttagaaggtcacctaattctggatatctttgaacaaccgcttgcagataagtagagttgatgtcaattccatatactttttcaaatctgtctttttgaatatgttcaagaccattcccgccagcaataccaaatatcattacactagaaatgggataagtatcaaattgacctttcatcattttgttcatagcttgtaattgcataactgaatcaagcttcatatgactctcataatcagttaatggtatttctttccatggatttttcatttttcacctcattaaatactaaattatttatttttatattctattataatgatttcatatattaccagcaatgaaaatctaatttgctggcttattttttgattttataggtggtaaattattttataaatataatataaaatggatgaaaagggtaaaataagcaaaaaacttgaatataaaaagtttaaataatacaatatctaattattaatggttagatttttagaaaaaagaatttaaagttaaaatattgatatataagatattatttgctaggatattaaaaatgagagttgtagtaggtgtggaggattttaaattagatgattggattgggtacattatttaatgtcatagctattgttattgggggaactgttggttttttagttagaaaaggaatgaaaaatcattatcaagatactttgatgatgacaatgggagtatgtgttattttcattggaatatctggagcactaaaagaaatgctgataattgataatggtgttattaatactacagggacaattatgatgatcagcagtttttttataggatcattaataggtgaatggctaggaattgaaaaacatattgaacaatttggaaattggttaaagaaaaaaaactaataatgatgacgatgcttcatttatcaatggttttgttactgcttctttaactgtgtgtgttggtgcaatggcagttattggtgctttacaagctggtattatgaaagattattctactttgatagcaaaaggaatcattgatatggtaattattatgatcatgacaacaaccttaggtaaaggatgtatttttgcagcaataccggtggggatttttcagggcgcaataactatctttgctaaaatcgtggaaccagttatgacgatgcaggcattatcaaatctttcattaactggttcgatcatgatttttattgtcggtgtgaatcttgtttggaagaaaaatattagagtagcaaatatgcttccaacacttatttttgcggttatatttgcatttttaccattttaagagaggagatattatgaataatacgaaaaaaggaattatatatattattttggcagctttcttttttgcagccatgaatgtttttgtgaaattatctggggatattccctcaattcaaaaaagtttttttagaaatttattggctgcgatatttgctttaggtgttttgattaaaaataaagaagattttaagtatcaaaaaaaagatattccgatgctattattgcgttctatgtttggaacactgggaatattatgtaatttttatgcagtagatcatcttttggttagtgatgcttcgatgctcaataaattatcaccattttttgtaattattttttcagctttatttcttaaagaaaaagctaattatattcaaaagatatcaattatagttgcttttattgggagtttatttgttatcaaaccatcatttgattttatgaataatattaattctttaattggtgtttgtggcgcattaggagcgggaattgcctatacttgtgttagacaattaggaaaacaaggtgtaaatagtgcaaagatcgttttctttttctcttgtttttcatgtatttcagttttaccttatattgcactaaattatgtttcaatgtctttacaacaattgcttttattaattggaacgggattaatggcggcaggtggacaattttcaattactgcggcttatactcatgcgccaggtaaagatatttctgtatatgattatacgcaaattctttttgctgcgttattaggtttctttgttttgggacaaattccggatttatttagtattataggatatgtaattataattggaattgctgtttttagttttgtttatcagcgtaaaatggttgattagatataatgattttaatagcacttaatcctttatttgaaaatgaaggatttttattttatttatctaatattatatttaattctaaaattacgaataattaaaaattaatcttagtatttttattgattttttgttttagacattttagttattttgtctattttataatacaatttatcagcgtataatcaaaattatattttggaaaggagaaaatatattgtagatgataataaattagtgaattatctataatataatggaaaggaaatggaaaagaaaaacgggataaaaaagtttataatttgtataataagtgcaatgatttgtattagtatgttgccttataaagctgtatgggcaaaagatgatgaattagttgttcctgattttaataagtacacgtcaggagactatatatttgaaaaattttctcatgctgataaaccaagacaatcaccagatggaattgttgattatgttggtaatggtgatgtaaaaacatatacacctggtcaaagtgaagatgagtcctatggtgatcgtggtcaaagttattcttgggcagcaattacttatggtgattatgtttatgtaggtacttgttatgctgcaatgggaaatactttaaaattgatggatggtgtcttaggtaataaatttgatattgaagtcatgagagctactttaaataccctttttaatggtacatttttctatgggcaagaagatggtgtggattctcaagggattttagtgaaagttaatatcaatactggtgaaactgaattattgatgtctaaaaatactactggacaagcaccgctattcagaaatgcaattgaatataataataaattatatttttgtggtagtgtaagttcaaatggagtagggttacctagtatttatgaaatagatcctaaaactgataaaattcaggaagtttacactggtttaactttgcaggaatatggtcaagcttataaagaaggtatttgtacaggaattcgtgggatgacagtttatgataaccagttagttgttagctgtgttggtttaaatggcccttatattatgattacatcgaatccttctgatcgcaattcttttaaagtaattgcagataaagatgatttatttaattatcctgcttatcactatgaagatagtatttatggcggttctatctgggaaatagcttcatataatggaagtctttatgttgcaatgtgtacagggactccagataataagccagatgaacatacaatgcaatcttttgcaatcgttcgaggtgatgaaaagtctgatggtacatggcagtggacaagtgttattggtgacaaagaaaaggataatgctaaatatacttttggtattgatccgcaaagaactcgagctggtgcttgtaatatggtgatttataatgattatctttacattggtgaatatgaagatattgaaatagctttagaagatgctatatttaatactaacgttgagtttttagccaaaaatttggaacaatcagttaatctttatcgtatggataaaaatgaaaatattgaacttgttgtaggagatgctacagatatgtttcctgatggaggcgtttcaggtattagttctggttttggacatcatgaaaatcaatatatttggcagtcagttgtatatgacgggaaactttatttaggaacgtttgatagtagtagtttattagaaccaattgggcagtttactaatggtgatttaattaatcgtgaaccagaagaatggcagtcacaaattgcgtatattaaagttcttttagaattgttggcacaaaaaaatgatagtggttctaattttaaactaatgagagaatctaattctcaagaaaaagcttatgcaatggtagaagaagctattgaacttgcaaacgatcgttataaaaatatggctataagtccttatagtcaaaataaaaaatcaagtcaaaatagtatagctttatcaaatgaacaaaaagagcagcttgctaatgatattcttaatgggactattgctactgattcattagaagcaaaaactgctgaagaattagcagtcttaaatgcaaaattagcactttgtgatgattatttaaataaaaaaggtagtgaagaatttataaatatatatgaagagctttatcaaatttacaaaactattgaagacaagatttcaggtcttccaaatatacttgatgagttatatgataaattattaaatatgatgacattagataatcttaaagcttttaaagaatgtttagaatatctttcaacagctacaagaggatttgacatgtacgtaactgatgatggaactaattttgaaactattacaacagatggttttaatgatccatataatcatggattaagaatttttgcaacatctgatgattggatggttgtaggaacagcaaacccattttatggtactcagttatggaggatgaaaggcgaaggtagaaatagtgattctatcaatcctaatgatcctgctaattctattaaaccagggacacctgatcgggtagcaatgtcagatgattctaaaaaatcaccagatacagttaatacaggagattatcaaaatattgctttatggataatggctgtggttacattaggaactactgcggcttatattcatggaaagaagaaaaaatcgcttaattaattttaaatataaaaattattaatataaatgcaggtatcagcctgcattttttaataaaagtataggttaattgtaactttctttaatttgggttaaaataaaaagaggtgatttttatgtatattcaaacacaaaatcaatccattatttttgaaagtgatgaattgacagatatgcttgggaaaatgacttttcaaattcatagttttgataaatgggtatctagtcatgatacaagagcaagttatatttatgatgatatagagatcgtatgttatcgtgaaggtggttctacaacgattattggtaataagaaatatcattgtaaaccaggaagttttttagtattagagccatcacgactgattaccactattaatgaaggctatgaaaaatattcattttatcactttcattttgatattgaacctgtttatttaaagcatcagtttctttcattattaacaaaacatggacatatgatcgaagcccatgaaatgttggattatacagaaatgctagataggctatatttggaggctcagagaaaagaaattggttattctaatattattacttcagcactgattcgtttgattgtccaaatgatgagagctcaattaaaacgtagtcaagataatcatatcgaaataattgattcaccgtacattcaagtagttaatgaggctatagtttatattcaaaatcatttatttgaatcaattagattaagcacgatgtcacaagtaattggagtatctaatagtgttttatataaagcttttactaatgtgttgaatattccaccagcaaaatatattcatcaacaaaaaattcaatatgctcaaaaaagattgcttcttaataagacagtaactgaagttgctcaagagttgggatattcttcagcatatcatctatcaaaagcttttaaacaagtagttgggatgagtccaagagagtataaaaaagtaatgagtttaaaaaatagaatttaaagataaaaatagtatatatagatttctttagatactaaattccagcatataaaattgtaaaatatcgataaatatgatggatataaattgattaaaataatttttgaaagataaccttagcatcgttaattttattaaagaaataattaaaaagctataaataaagaagataatgtcagtataattaaatcacaaagtgaaagttcttttgatgaagagatattaggatgttaaaaagaagaaaatacagatagtttaattatataattttaccaggtgaaatttttaataaaatgtctaaacctcttgtcagagtaagggttcaggagaatatgatagaaaattataaaaagaagaatttagctggtaaaaaaatagaaagttgttgatatatataagctttgaggtataatggaaaatgtaaagtggctaatttactagggtttaataacaacataagatgtattgaaattagaaatacgttcattagtattgataataattttttgtttaataacaacataagatgtattgaaattttgctcggacccccgtaaaaatgtagatcaaagctagtttaataacaacataagatgtattgaaattgataataactttcgagaacacatcttaatgcccacgtttaataacaacataagatgtattgaaatagactttgtggataagaagaacgcatttcactagtatgtttaataacaacataagatgtattgaaataaagttaatagacgcgtatgaaaacaaatatgaaatgtttaataacaacataagatgtattgaaatggagcttataaagatgttgacaaaggaaaaaagcgtttaataacaacatgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactgttccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagtgattcactaaaacttttcataataaatgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcgtggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataattcaccgaataacaattatatggcagttgcataagcctttccttttctcatcgccacatcatctattccaatagactcgacatcagggtcatcttcaataatgatcttatcagtcaggcgtttgatagagtcattgcttatattgaccccaagaagtttcagtactttactggcaccttcattgcttaaaaagagagaaactgcaaggataagacagttaagctcatctgttcttctttgagagggagaaacaaaaggaagattctgcataataacctttctattgcatttgtcattagtacagtcatatttataagcaatcacatcaataaaagttgttttatttctaacaggataagcctgaatcattctatgataggtattatgtaaagaacttgtaggagaaccacatacaggacatacatcatcatgagaagtcgctttcacatatattatgattttattatctgattctttccagtcatagacaatgaagtcattaccaaagattttttcattcaaactgatttcattatatttcatatgtatcaccatccatacatatattgtatcaaaatgcccaaaaacaagaaatacaaactaaagaaaaacagcacaatttcttgtgctgtctaataagttcatttacccataagcgagtaagaaccttgaaaattatctatctttttatgttttaatcatctcaataaatctaggtttggtgattaattatattgatatttacttttaatagaaaagtactaattaaacaaaataagaactttttaagatcttatttacaagcttcttcgatagaaacgggttgtttttttctaaatggatttataagtctattgaagtctcaataagttctaataattatcagtaaatttttatataaaataatttttaagatttgtgtgcaacgtgtaagcaactcacaacttctgatatcgactcatgaaattttttgatgaaaattattgttttgtatatgatattaaagggtgcttatgttataatttttacttataattaaaaatttatcaaactgtttattttaatatagcattttaatacagacattatttgttaagaataaatatatgtcttaaaaaatctttatggtataatatttttatattaattaagaatggagagggaaatttaacatgaacaatgaagtttatatgaattttatcgaagaacgtttttatgttttgaagcatagagtagaattaaggtcaacgcttaatattcttaatttacatattcgatcagaagatttttatagagaattatttaatttgatttatgattttaagctggcaaatgccaacgttttagagcaaaatgcttcctcgatagatttaattgataatgaaaataaagtaatatttcaagtaacgtgtactgctacaaaaaataagattgaaaaaacattgtctaaacaaatattaaaagaaagatattcagattatactttatattttatttttataggtaagagcgcgaaaaagttaatagggagaggatataataatccttatgatatttcttttgattctaaaaaaaatatatatgatattgatcttattttaaaaaaaattaattcattaaatattgacgatttaaaacgagtttatgatttagttatgaaatatttgaaattgatagatatatcacaggtgagagtaaattctttacttccaaaagtaataaaagcactatgtacatatgataatgaagatgattttgaaatgataaatgatacaaaaatttatgaaatatcagaaaaaataaaattcaataatttagaagaaagcgaatttgtaattaatacgtgggcaccatacgaatgtgttatggttaaaatatatgaggaatttgatcaaaatggaaaattaaaatctgaagcattattaatgaaatttaatagaaaatatagagaattaagaaaaaaaattaacaatgaagatgatttgttttttgaaattattagatctttaaaagatgaaatgataagtgatgaggaattaattacatctgatatttcagaagaagaacttgaaacatgtatagaaattatcattgtagatgcatttataaggtgtaaaatatttgagaagccaggaggtgtaaattcatgattttatcaaataattcaaatcctaagaacagtttatattttattggcggaattatactaatactaatgaaaaaaaaagaggaatatgattatttagaattatatacagaattgagaaaaagtcataatatttcttttcaactatataattatgctctagattggttatatttgatttcagcaattaaatttgatgaaaaggaaggtgttataaagtgtttttaaaacaacttttaattctaaaaagtggatcaattattcgtgatataaaatttcataatggattgaacttaattgtggacgaaacaaaagaaggggaagtatcgacatctactgggaataatgttgggaaaacaacagtattaaaattgatatatttttgttttggaggagatgctaaagaaatttatacttcaacagagaattcaaaagatgaatatctgttagttaaagattttttgattaataatgatattgtaattagactggtgttaaaagaaaatttagatgttgaagattcaaaagaaatagtagtagaaagaaattttttaaaaagacaaaaatcatatagaaaaataaatggtaaaaaatatactgaaaaagaatttagcaaagagttaaaaaaaatgttatttaatggattggtggcagaaaagccaacattaaagcaacttgtaggacataacattagatataagaatagaggtatttcaaatactataaaatatttagattcatatacaaaagatgtagagtatgaaactttatatttatatttattaggatgttcacatgtaaaaggacaacaaaaagaagaattattaacacaactttctcaagaaaagaaatataaaagccgcttggaatcaaatgctacaaaaaataattatattgtaatgttagctgcaataaataatgaaattgaaaagctaaatatgaagaaagccaacttaaatattaacgagagttttgaggaagatttagaaatgctaaataatattaaacgtgatataaatcatataacagaagcaatttcgctcttgaaaattagaaaagatttaattaatgaatctaaacaggagttggaaaagaatagtgttgatatcgatttagtggagttaaaaacgatttatgaagaagtatcagaaaatttgggaactttaaataaaactttttctgatctggtaaattaccataatgctatgataaataataaggtgaaatatattactaaggaattgccgttgatagaagataaaataaattcttacaatgagcagttaacaaaattattagaagatgaaaaaaaatattctattcttttgaaaaaaagtgatacttttgatgatttagaattaattataaaagaattaaattcaaagtttcaaaaaaagggagaatatgaaggaataatttctaaaattgaagaatctgaaaagcaaactaaaattattgaagatagtattgaaaaaattaatgatgaaataatgtctaaggaatatcaagaagatgtaaaagttcaagttactgaatttaataaatattttgaagaaatatctcaatatctatatgatgaaaagtatttgttatcttatgatctaaaaactactaaaaataatcaatcatattatgtgtttagtacttttaatgaaaatttaagttcaggaaagaaacaaggagaaattttatgctttgatattgctcttataaaattttcacgtgatttagggctggctcatttatcgtttatattaaatgataagaaagagctaatggacaatcatcaattactaaaggttgctacatatgcaaaagaaaataatattcaattagtattttctatgctcgcagataaaattccagagagtttaaataatgatacaaatattgttttaagattatcacaagtaagcaagctatttaaaattgaagaataaaaagaaaagttctgatcaaataaaatcagaactttttaaaatcttgtatttgtttgtgcttatttacaagcttcttcgattgctacggcaacagcaacagttgcaccaaccattgggttgttacccataccgattaatcccatcatttctacgtgtgcaggaactgatgaagaaccagcaaattgtgcatcactgtgcatacgtcccatagtatctgtcataccataagaagcaggaccagcagccatattatcagggtgtaaagtacgtccagttcctccaccagaagcaactgagaaatattttttaccttgttcaatacattcttttttatatgttccagcaacaggatgttggaaacgagtagggttagtagagttaccagtaattgatacgtctacaccttctttatgcataattgcaacaccttctctaacatcatcagcaccatagcagttaactttagcacgaggtccgtctgagtaagctgttcttgataattcttttacttcacctgtaaaataatcgaattgagtttccacgtaagtgaatccgttaattcttgagataattttagcagcatcttttcctaaaccgtttaagataactcttaatggttttgttctaactttattagctttttcagcaattttgattgcaccttcagcagcagcgaaagattcatgacctgctaagaaagcaaaacattcagttttttcatctaataacatagaacctaagttaccatgtcctaatccaactttacgatcatcagcaactgatcctggaatacagaatgattgtaaaccaataccgattgttttagcagcttctactgctttagtatctccatttttgatagccattgctgcacctacagtgtaagcccaacaagcattttcaaaacaaattggttgtgttgattttacgatttcgtaaacatcaatacctttttcatcgcagatagctttagcttcttcgattgatttgatatcaaattttgctaatgcagcgttaatttgatcaattcttctttcataactttcaaataatgccattttagtaccctcctattattcctttcttggatcgatgtacttagcagcatcattaaatctaccgtaagtaccagtagcttccttgattgcttcattagcatcttttccagctttaaccatatccatcattctacctaaatttgtaaattcataaccgatgatttcatcattttcatctaaagcgatcttattgatgtatccttcagttaattctaggtaacgagggcctttagcttttgtagagtaagaagtaccagtcatacttcttagaccttttcctaaatcttccaatccagctcctacaggtaatccgttttcagagaatgcagattgagtacgtccatatacgatttgtaagaataattctctcattgcagtattaatagcatcacaaactaaatcagtatttaaaccttctaataaagttttaccaactaatgcttctgaagccattgctgcagaatgagtcattcctgaacacccaattgtttcaattagtgcttcttcaataatcccttctttaacgtttaatgttaatttgcaggcaccttgttgaggagcacaccaaccaataccgtgtgttaatccagagatatctttaatttctctagaatatacccattttccttcttcaggaattggagcacaaccatgtgatgcaccttgtttgacacaacacatttcttctacttcatgtgaataaatcattttttctaactcccttcgtgttttcgattataaatagctagtcacactatttaaggcgaactaaaatcacctgagtaaagtatagaataaagcagagttaaagtcaatgaaacatcaatgataaaaaaataaattcgacattttttttcgataaaagacatacaagatagtttattatatgattcttgggagaaattaaattttataatattttgcttgcaaagaaggttagattgtgctaacttattagtagttaggtttttctaacttcatgtgaataaatgattttttctataggcttagtcaccctataagaaagaatcaaagaggaggaaattatagatgagtaaaattaaaactatttatgctcgtgaagtattagattcacgtggtaatcctactgtagaggttgaagttactacagaaaaaggtgcatttggtagtgcaatcgtacctagtggtgcatctactggaatttatgaagccgttgaattaagagacggtgataaatctcgttatttaggtaaaggtgttgctaacgctgtaaaaaatgcaaatgaaattattgctcctgcattagtaggtgaagatgtttttgaacaaagaaagatcgatcaaatgatgattgatttagatggtactgataataaagggaaattaggagctaatgctattttaggtgtttctttagctgttgctaaagctgctgctaatgaattagatgtacctttatatcgttatatcggtggttctaatgcgcatgttcttccaaccccaatgatgaatattattaatggtggagctcatgctgataacaatgtggatttccaagaattcatgatcatgccagtgagtgcaccaacttttaaagaagcaatcagaatgggtgcagaagttttccattctttaaaagctgttttacatggaaaaggattaaatacagctgttggtgatgaaggtggatttgcaccaaacttagcttcaaatgaagatgctatcaagacaatcatcgaagcaattgaaaaagctggttataaacctggtgaagatgttaaattagctatggatgttgccagcagcgaattctataaagatggtaaatatgtattaccaggtgaaaataacaagtcattcacttcaaaagaattagttgatttttatgctgaattatgtgctaaatatccaattatctcaatcgaagatggtttagaccaagatgattgggaaggttgggattacttaactgaaaaattaggtgataaagtacaattagttggagatgatttctttgtaactaacactaaacgtttagaacaaggaattgcacgcggtgttgctaattcgatcttgatcaaagttaatcaaatcggtactttaacagaaacattagaagcaattgaaatggctcaaaaagctaattacacagctgttgtttcacatcgttctggagaaacagaagatacaactattgctgatattgctgtagcaactaatgctggtcaaattaaaactggttctgcatcaagaacagatcgtattgctaaatataatcaattaatcagaattgaagatcgtttaggtaaagaaagtaaatattctggattaactggattttatcaattagataaataatttaaaaaaatacttgcataattagttagcgtatgctaacatatagatagttagttaatgctaactatagaaaaggagaagagtatgaaagtagtatatgcctcaagaacaggaaatgtgcaaagtatcattgatcaactagataatgattctttagaaatcagttctggtgatgaagtagtagaagaaccatatattttatttacttatactgatggttttggagatgtacctccagaagtagaatcattcttagaaaacaatggccaaaatattaaaggtgtcgttgttagtggtgatcaaggatatggtgaagcatactgtaaagcaggtgatgtcatcgctgaacaatacaacgttccttgtctatacaaagtcgagaatgctggaacagacgaagatattacaaaaatcaaagaattagttaaataatataataaatctatgtttgattaatatcccaatgcctacacaataattttcaaatcttagtaatattaatcagctttaatatatatctaaaatatctaaacttacctttttcttgacacaaagatatatatattcccgttgaaaatagtatgaaatatttgtgatatcggtaggcttcttgattaacttattatgttttaaccttcaaaaacataatagtaaaaaataaatcatttataaataaccttcaagtcttatgatttatttttagtcaaatatgaacaaaattagggtccacatccaatatattgatatcaataatttagccattataattatcaatttcctaattgttcatcgataaaaccagattaatctggttttatttttttcgatttattggtatactaataatggaggttgttattcatgcatgaatcaggagaaatgtatttagaaacaatactaattttaaaaaataaaaatgagtatgttcgctcaatcgatattgcaagacaattaggttttagtaaacctagtgttagccgtggaattggaattttaaaaactgatggatatattacagttaatgataaagggtatatcgatttaacagacaaaggaagagaaagagctaattttatttatgaaaagcatcaaattttaactgagtttttgatgaatacagcaagtgttactaaagaaattgctgaaggtgatgcttgtaagatcgaacacattatcagtgatgaggtatttgatggaatcaaaaaatttctaaatacagaggataaaacgtaagaattttcttacgttttattgtgcttaaattaaatgattgacaataattttttattgatctattcttgatttatgagttaccggcaactctaaaaaaggagtgaagaataactatgtatcatgaaagatttaaagggacccattatgaaataggtataaataggggtagtagattactaaaaaataatcgttgctttctagacaacgttccatttgaaataacaaaagaaagaaaggactttgctttacaatgcttgccattatatcaaaaatattttcccgaaatcattgaagaaatcaaaggaatcgtcgctagtcaacaatgttcatttgaagcagtatgtgcagtattgttcagtatgtattgtatcttacctgaagttcattgttcttgttttgtaataaaaaatgaacaggaattattatttggacgaaatagtgattttttaccagaaatcgaaaaattatctagtaattgtatttatcgatttaatggtgattcatatgcttttactgggaataccacagcatgtgtggaaatggaagatggcatcaatgagcatgctttagcaatcggtctgacttctgtttatccaactgttaaacagcctggattgaatgcgggaatgttattgcggttatttttagaaaagtgtaaaacggtagacgaagtaattgcattgatcaaaacgttacccattgcttcaagtcaaacttttactttggctgatgccagtggaaagatagctgtaattgaatgtaatgctgaaaaaatcgagattattaccgatagtaagtatgtttgggcaacaaatttatttcatagtgataaaatgaagctttataataattatattaatgatgattgggacgctgagcgtcgttatttaacgataagaaatgctttattaaatgaacaaattaaaacatttaatgatgttgctgatctattgtctggaaagtacggttttatttgtcagtatgatcgtagtatgaacaaagatacagtctggtcagtaatatatgatttaaagaataaaaagatttatcgcgtagaaggtaatccatcacgtaaaaaatttattgaagataaaagatttaaattggattagaaactactctatgcagctaatatcatttaaaacagatagtaatctagaaatagatagctatctgttttgataaaaagtgtttatattaaaaaaagctaaattagtcctttttaaaaatactacatatatgatggtattaaataaagatatatataggtagtttatttacaattatgcaggtagaaaaatcttaataatattttaatatgatcatttattataagtataaagatgatcagattaaaaatcggtaaagtaacattggggataaaattcaagacgcaaggatagtgatcaaataagcaatattttattcatttatcagcgctctcaactaattttaaataatgatcgatataagctaaattatgcagtttttaattagagataaataaatatttataacaggcagcagcactaatgatcaaagtaatcaataacccgactagtaaactgattgcgatactgaagacacctaaataatgactcaatacatacactaatattatttcgctggtgcattcaataatactgctgataaacattagtttattacgatttagtgcttgtaataaagcgctaagcggggtttgaaggtaaaagatcgtaaaaggaatagccatatatttaagataattagcaccactagtcgtattatataagagctttaaacagaattcaggaataaaataaaaaatcaaggtaaaagggatgctgatcaaaaaacttcctagtaaagctaaaaatatatgttttctagccaaaaatatttttttatagacaacgtcatcagtaatgattggtaaaaatagccgatagacaacattattaaaaaaagtcggggtaaccaataaagaaataacataaccactaataatcgcatattgttgatgaatagtactttcacttagattaaattttgttaatacataaaccagggtaattggctctaaaaaagaaacaatacagtgatatagtctggaaccagttaacggcatcgcaatattcaacatatcttttatttgtaagttattaataatgctttgtttactaaaagtagtgattttatgattttttaaacgagttgaaagataaatgatcgagcttaattctcccactgacatagctaatgtggcaaaacttactaaataagtatctgccaaaaaagagaattgtttgatcattaaataactgaaacttaaacgggctatttcttcaataaaaccagcttttgcaacaaggtaaacattttgctgggctaaaaaataatttttgatgataccgcttattcccactaaaggaataaacagggctaatgatagtaaaggataaaaggcaccctcattttttaataaattatgactaataaattttgaagcaaatagcagggtgctcattacaatgacacatgtaaaaagacagatcgtaaaagcagaaataacaatttttttattactatatttaggattagctactaatctgaatactgctgaaggaattcctaactgtcctaaagtaatacataaagatactgtaggcataactaagatatatagcgccatagcatcactgcttaattgacgtgctaaaaccattctattaagaatactgaataattttgcgatggcagaactagcggaaagaatgataaatgaatttattagttttcttttcataaagcacttcctttctgatgaattttgtcatataatatgtaagtgactttgaaatggagggctgtaagtggaatcgagtaacgattttaaatttaataaacgtgatcttaattttttaattaaattaaaagcccgtgactttaaacaacaaaatattcacaatatttctgaacagcaaataaaagattatttgtttgaacgaaaatggaaacaaagagatgctattccgatgtgtgaaattattgatgatatcatgagtcttgatttttcggaaatatttgattatttaagtttacaagtagtaaaagaagcatctcgtttgagtataaatgatttttcagatttaatttcaaaatagttgctgatgcaactatttttgtttgagaggaggactttatggagtggcagatcataaataatttagactacaaacactatatgcaagaatataatataaattcacttttagcgaagatttttgcttataaaaattattcttcgcaacaaattgaagcaatgctttcaaatcgtttgatatatcatgatttttcattgttttcagaagcagagctgacattagaaaaaattaatgaagcaatcgccaacaaagaaaaaatttgtatttacggtgactatgactgtgatggtattctagcgacatcaattttagtagatgcttttagacagttaggcatcgaagttggttttcatatccctaatcgtttacaagatggatatggtttaaataaacagcgtgttgaacagatggcagcaaaaggctatacacttatcattactgttgataatggaataaaagcctatgaggcaattgaaagagcaaatgaactgggggtcgatgtaatcgtcactgatcatcataattacgatgatcaattaccagatgccttttcaatcattcatgctaagatttcccctgattatccttataaagaaatatcaggaggattcgtggcgtacaaattagctagtgcgttattaaaaaaacatgataaatatttattttgtttagcggcaataacaactatttccgacatgatgcctttattagatgaaaaccgggcattagttaaaagagcactagaatttatgaaagaaaaccaatatccccaattagaattattacttggtggtaatcaaaaatataatgttactagtattggctttatattagcccctaaaatcaattcatttggacgccttagtgaaattattaatcctaatcatctagttaaatattttcgccaagacgcatcgatcgggctattaacagcagtaagttcgaaagctgttgaagtcaacgctaaaagacaagaattgacaaataagcagtatcaggaggttcttgccgcagttgacgtaaatgataaatttttatatagctatcaaaatgaagttcatgaaggcttgattggtttggtggctggcaagtatactcgtcaatataatcggccaagttttgtcatgagtcttgataaggaaaaaaatatgtataaaggcagtgctagaggaatcgaaggcttatctttaagtagtatttttaagcaggttgaagatgttttggataattatggtggtcatgctctagcgggtggttttagtgtatctgttgataatgtagaaattcttaaatctaagctaacaagatatttagaagaacagttagaaaactatcagccgccgttagttgaggtattagaagtttcagaagatgaaattagtaaaaatgctgtaaaacagttagaacttttagaacccttaggtaatggcaatgaagaagtctgtttctatgcaaagaacttatcagttaaaaaagtaactcctttatcgaatgggaaacatcttcgttttgatcttgaattaccaaaagtacggggccaagcgttatattttaatcatggtgaattgtatgaacagtataaagatattgaaaagattaatgtggttgggaagtttagtatcaatgtttttaataattttgaatctgtaaatataattattgagggaattaaatagttttaattaatgtataaaaatgttataattgaatatcataaggcatggttgtaaaggagaagatataaaaaatggatttaactaaatatgtagctgatataaaggattttccagaagaaggaattatttttagagatgtaacgcctttaatgcaggataaagatgcatttaaagaaacgatcaataaatttgttgactggactaatactttagagacaaaagttgatgttgttgcgggaccagaagcacggggatttttatttggctgtccggtagcttataagatcgatgcaggctttgtaccagttagaaaacctggtaaattaccacgagaaacaataagtgaaacatatgcattagagtatggaacaaacgaagttcatattcatgctgatagtatcaagccaaatcaaaatgttattattgttgatgatttgcttgcaaccggtggaactgttgaagcgactgttaaattggtcgaaaaattaggtggtaaagtaattggaattgcatttttaattgaactggaagaattaaaaggacgtgaaagattacaaggttataatgtttattcattattgaaatattaaaaagagctaagctcttttttaataattatgggaggtgttatttatggctgaatataaaggggcaggagatgttgtttcaataaaaaatgttcttgaggtttgtggcaaatatattactaatcaagaaagtcttactttgattaatcaggcttatgattatattatggaaaagcataaagggcaaaaaagaaagagtggggaaccatatactaatcatttgatctgggttgcttatattttagcaactttacagacaggacctgcgacaattactgctggtttgcttcatgatgttatggaggactgtgatgtaagtcgagaagaaatggtggaacgttttggtgaagaaatcacaacactagttgaaggagtaaccaagatcggtaagatgccgtttaaagatgaggcagatgtttatgcagaaaatcaccgtaaaatttatattgcgatggcaaaagatattcgtgttatattaattaaatttgctgatcgtttgcacaatatgcgaacattacaatatatgcctgctcataaacaaaaaagaattgctagagagacattggaagtctatactccaattgcccatcgtttagggatcaatgatatcaagacagaattagaagatttaagtctttcgtatctagatcccgttgcttttaacgatatctctaatcttttggcagtaaaacaggaagaaagaaaagaatctgttgcaaaaatgatggcatcggttgaaacaatgcttaatgaaaataaatatgagtatcgaatcttaggtcgggctaaatcaatttatagtatttataaaaaaatgtttgttaaaaagaaacgatttgatgaattgtatgatctatatgctttacggatcattactaaggataagatggattgttatagtattttaggattgattcatgatcattatcgcccaattcccggacggtttaaagattatattgcaatgcctaaacctaacatgtatcaatctttgcacacttcggtaattggtgaagatggtaatacttttgaaattcaaatcagaactgaagaaatggatgaacttgcagaattaggagtagctgcacactggcgttataaagaaaataaaggttattcatcgaaaaaagaacaacaggaaattggtgaaaagttacagtggttaagagaatttatttctttaagtgaagatataaaagatggtgatgctaaagaatactatgattctttaaaaagagatatttttgaagctaatgtctatgttttgacaccacaagggaagatcgttgagttacccaatggttcgacccctattgattttgcttatcggattcataccgaagttggccataaggccgttggtgcgatagttaataatgtgatggttccgatcgatacaaaattaaatacaggtgatgtcgtagaaatcaagacaaataaacagtcacaggggcctagtgatgactggttaaaatttgttcgtactgccggtgctcgtaataagattagacagttcattgcttctagagaggctgagacgaaaaaagatgcaatcgaagatggtcgtaagattttaagagatgagcttagaaaaagacagttaaatgaaaagaagtatcttgatccagatacttataagacttttttagggtcatttggcgcacgttcatttgatgatatattgtattttattgggaaaaaaagtttgccggcaatgacattgatcgatcgtgtcgttcctaaaaaaagcggttttttcgatagtatttcaaaaatgctgcaaagaaataatcaggtcaatgaccgtcaacaggcagcaaagagcagctctggtgtagttgttaaaggaatcgatggtttaaaaattcagttatcaaaatgctgcaatcctattcccggcgatgaaattttaggttttgtttctcaagggcagggaattaaagtgcatcgtaaagattgtccaaatatccaggttcctgaagtcaaagcccgattgatcgatgtttattgggattttgcttcaatttcaacgatgaaattccaggctgatctagagattaccggtttagatcgaacaaatttattgaatgatgttattactgttttaggacaaacaaagatcaatattttaaatattcgtgctgatgtggttgatatgaaagctattattaagcttaagatttcggttgaagatgcctctcgtttacaacaggcaattgataatattgacagaattcagggtatttttgaagttaaaagagttattcactagtgttattatttattgataaaatataaaaatgatttatttaaagacataaaaagatcgttttctattaagtgataatagacgatgatcttttttgttgtttagtaataagttttttaaactaattaataaaagcgttgttttaatggaagaaaggcctatgtgatttgtaaattttcatgggccaagatcaaaatttataccatggaatatttagtttatatctatattctatgcgtttttgaaaaagtaaagataataataagattttcaaaaaatcttttttcataaataatcaatatttatccaatcaaatcattgattttttttaaataatcgaatataatcattttaatccaatgaacaagattaaacagctaagtcttttcatagagagaatacggttggtgaaagtatttaaaaagaaatgctgtgggacacttgggaggagttactttgaaattagtaggagtaaacgtacgtcgcgttaagacaagagggcatgtataattacatgaattaaggtggtaccgcgtttttaacgtccttattttaaggacgtttttatattttaaaggaggaagagaaaatgatgtataaagccccacgtggaacagtagatattttgccagaaaatactgcgaaatggcaaatgctggaacaattaattagaacgatttgtgctaactataatgttaaagaagtgagaactccaatttttgagcatactgagttatttaaccgcgcagttggtgatacaactgatgtcgttagtaaagaaatgtatacttttaatgataaaaaaggacgctcaattacccttagaccagaaggaacagcgggagtagctcgggcatatgttgaaaataagatgtttgctagtcctgataagatttctaagttatattatattggaccgatgtttagatatgaacgtccccaaaatggacgtcagcgtcaatttcatcaatttggagtagaaatgattggttatgaatcaccatttttagacgttgaatgtatgacgatggcagttacattagttgaagcattaggtttaaaaggggttaaattacatatcaatactttaggtgatgaagcaagtcgtgatgcttatcgtaaggctttaaaagaacactttagtgcccatttagatgaattgtgcagtgattgtaaaagccgttttgaaactaatccattacgtattttagattgtaaagttgatcatgatcatccagcgatggcgaatgcgccaaaaacaattgattatttaagtgatgaagctaaagcccactttactaaagtatgtgagttattagatgatttagaaattgaatatgagttagatactaacttagttagaggtttagattattattgtcatactgtttttgaagttatttctgatgatccacgtttaggagccggagcaactgttggcggtggtggccgttataacggtttaattagtgaattgggtggtcccgaagctccaggtgttggttttgcttttggaatggaacggttattgattgcgatggatgatgaattacaggaaacagaaggcttagatgtatacgttatgcctttaggtgctaaggctaaagatttagcgttacaaattacgacgatgttaagagctaatggttttagtgttgatatggattatcaagatcgttctttaaaagcccaatttaaaactgttgatcgcatgaatagtcattttgcgatgattattggtgatcaagaggtagaagatgaagtcgtaaatattaaatgtacgcattctaaaacccaggatgttgtaccaattgaaaatattgttgcatatattgaaaatcatatggagggtcatagccatgaatagaactcataataatggagaattaagaatcagtgatgttaataaagttgttgaattaaaaggctgggtagctaaaaaaagaaatcttggctctttagtttttattgatttaagagatcgctatggaattacgcagatcgtcttaagtgaaagtatggaagctttagctaaagacattaaaaatgaatatgtgattcatgttgttggaaaagtaattgaacgaagttcaaaaaatcctaatatgccaactggtgagattgaaatcgaagctagtcaaatcgatattattaatacagctaatgtaacaccgatctatactactgatgatactgatgctagtgaagatgctagaatgcaatatcgctatttagatcttagaagaccagtgatgcaaaacaagcttattatgcgtcataaaattacgcgcagtattcgtgaatttttagataatcatgattttattgatattgaaacgccatatttaaaccgttcaacacctgaaggggcaagagactttttagtaccttcaagagttcataatggatctttttatgctttgccacaatcaccacaattgtttaaacaattattaatggtttctggatttgaacgttattatcaaattgctcgttgttttagagatgaagatctacgtttggatcggcaacctgaatttacacaagttgatgtggaaatgagttttatgactactgatgaaatcatttctatcggtgagggattgatcgctaaagtcatgaaagatgttaagggaattgatctgcaattgccactgccaagaatgacttggcatgaagctatggaaaaatatggaattgataaaccagatattcgttttggtttagaattggttaatttaaatgaagtcgttaaagatgttgattttatggtttttaaaagtgctttagaagctaatggtcatgttaaaggaatcaatgttaaaggtaaagcaaatgatttttcacgtaaagctatcgataaattaacggatatcgttaaaacatataaagctaaaggattagcctggttaaaagttaaagatggtaaaggtgaaggaccaattgcaaagttctttagcgacgaacaaatgagtcgtttattaacagcaatgaatgctaataatgatgatctattgttatttgtaagtgatgttaaatataatgttgtttgtgatgctttagcagcacttagaaatcatttaggtaaagaattaaaattatataataatgatgagtatgcatttttatgggtcgtagatttcccaatgtttgaatatgacgatgaaacagaacgttattatgctgttcatcatccatttacgcgtccaaaagatagcgatatcgataaaattgaaaatgatcctgcaaattgtttagcggatgcttatgatatcgtcttaaatggatttgaattgggtggtggatcacagcgtatttatgaacaggatctacaagaaagagcttttaaagcgttaggattcactcaagaaagaatcgatagtcagtttggctggtttgttgaagccttccaatatggaacgccacctcatggcggatttgcattaggattagaccgtttagcgatgctgcttactaatagtgataatattcgtgaagtaattgcgtttcctaaaaatgcaagtgctgtttgcccgatgtcaaaagcaccgggaaatgttgataaagtgcagttagatgaactaggaattgcggtgatcgaagatgaataaaaagcgaatcgatggtgtaattgcgagaatgaaggaagctgatcttgattatttactgatcagtgaaccttcatcaattgattatttgattgattacgttaatcatcctggggaaagaatgtacgtattgatgttatcagcaaaaggagatcataaattatttttcaatgatttattctttgttgaaaaagatttagggattgaaatagtttggcatagtgatgtcgatgatgcgatccaaacgatcgttgataatcttgataacgctaaaaaaattggtgtagataaacattggacagctaattttttacttgatctaatgaatagaataccggatgttaaaatagtaaatgggtcaaaatgtgttgattatcaaagaatggtaaaagatgaagatgaacaaaaactaatgattgaagcaagcattattaatgataaggcaatggatgaagtgattaaacaagttgctcttgggttaagtgaagttgaagtggctgctaagttaaatgatatttatagtgatcttggtgctgacggaaatagttttgatgcaatcattgcctatggtgctaatggcgcaaatccccatcatgaaaatgatgatagcactttagcacctggtgatagtgtcattattgatatggggtgtaaataccatggttattgttcagatatgacgagaactgttttttatcaagaagttagtgaagaagctaaaaaagtatatgaattggtaagaagtgctaatcaggcagctgaagcgatgatcaaacctggtgttagattatgtgatattgataaaacggctcgagatattattagtgaagctggttatggaaaggaattcaatcatcgtttaggacattttataggtaaagatgttcatgaatatggagatgtttcagtaaattttgatttagaagttcaagcaggaatgattttttcaatcgagccaggtgtttatttaccaggcaaatttggagttcgaattgaagatttagtaatggtgacaaaagacggctgtaaagtgttaaatagttattctaaagatctaatagtaatttaatgattaagagaattactcttaatcattttatttgtcgataaaaaattatactttttgggatacgttaaacacatttatcttaatttgtgctaaaatggtggagtgaggtgacagaaatgtattattttataggaattaaaggttcagggatggcgccacttgctgaaatcctatatgaacttggaaatgaagtatgtggaagtgatattgataaatatatttttatagaagatgagttaagaaagagaaatattccaatttactcatttaatgctgataatattaaagatggttatacggttattattggtaatgcttttgatgatgatcatgtcgaagttaaagcagcattagctaatcctaatgtcaaatgttatcgttattttgaatttttaggaaaatttatgaaaaattttatttctattagtgttgccggtactcatggtaaaacaacgacgacaggaatggcatatcatttgtttgaagattttgataaaacttctgtattgataggtgatggaactggtcatgcgactaaagatagtaaatattttattgctgaatcatgtgagttccaggatcattttttacattattatcctgattatgcaataatcaataatattgaattagatcatgttgattattttaagacgttagaccgttatatagaatcatttgaaaaatttgctaatcaagtcaaagatacggttattgtttggggtgatgatccgaacataaaaaaaattaaatttgaaaaaagagttatgagatttggtttaaatgactataatgacgttagggcggtaaatgtaattgaaaacaatttaggtttttcatttgatgtatatattcatgatgaattatttggacattttaatttaccattctttggtatgcatatgttatataattcacttgcaattattacccttggctatttagaaaatatgagtagtgaatatattcaagataagcttgcaacttttgagggtacaaaacgccgttatagtgttactgaggtgggaaataatgtttatgttgatgattatgcccatcatcctacagcaatcaaatatgttattgaagctactcgagttaaatatccggggaaaaagatcgttgcggtatttaaaccggatcgctattctcggggggctagatttgcagttgaatttgctcgagctatggatttagctgattatccttatttttgtccattccctgaaaatgctgtaaaagaagaaggaatcgatattgatatttacgatattgctaaaaatctaccaagagcaaaagttattggagaagatgaagaggcggctaaggaattagctaaatatgatggtgtcgtattcttgtttatgtcaagtaaagatatttataaacttgaagaaaaagttatcacgataaaaaaatctatataagtatttaaaattgtgatataatattttttagaaagtcgaggtaaagttatgactgctatagatatttgttactgtgttttaattttatcaggagcatttgctttagtttgtttaggaattttactgcttcgcagttcaacgacaataaagcaggtaggcagcacagttgaaatggctcaaactacgattaataaagcagaaaaaattatggatgatataacttataaactggatcttttaaatgctccagtagaaacaattgcccgtttctttgatccaaatcgacctaagtttaatccgattagtgctattattagtttgtttaaaaagaaattttagaaaggtgagattattatgaaatttggaaaatttatagctggtattggtattgggacaatagttggaatgttatttgccccaaaaaaaggtagtgagttaagagaagatcttaaagaaaaatcacaggaattatatgataaagcacagaatatcacaaaagaagatgttgagactttagttaataatacaattgaagaaataaaacttgctattgatgaatttgatatggaagaatttaaggacactacaagtactaaattatctgaagttaaaggaaaattagaagagctggcaaattctgttaaatcaagtgatgaatatgcaaattttaaagcatcagttacaaagattagtgatgaaatgacaagtaaattaaatgaaatcaaggacaagattcaagacaaagattttgatgcgttaaaggaattagatgatgcaatggatgatattgaagatgaattagatgtcatcattgaagatctaaaagattaatgaaaaaagttacgatatatgatgttgcaagggaagctggcgtttctcttgcgacagtttctcgagtaattaatggttcaaatgttgttcgagaaaaaactaaacaaaaagtcttggatgttattgaacgtttagatttcaaaccgaatgatatagctagaggattagcaactagtaaaacaacaactattgcaattgtttttccccagtcattatttgcccatgttaaagacatgattggtggtatcggtgatacaggaagacatttagattataatatcaatatgtatactactgatgatattggtgatggaaatacagtcgctgatgtaacagaacgcttggttaaatcaagagtggatggtgttattttattcaacaatgataatattgatgaaacaattgaagcgatcgttaagtataaattaccaatagttgtcataggtaagaagttatcaggtgacaacatcggttctatttatattgatgttaaaaaggcggcagaagagattgttgataaatatctagctgagggtaaagatgatataatttatattttacctaaacaaaatttgattaaaagtgatgaaataattgaaggtattaaagatacatataaaaaatatgaaaaagtttttacaactaatcagattttaaccagctcaagccattatgagaatacatatcctaattttgtagagtattttaaagatcataagcatgatttagtattttgcgggtatgataaagatggtgtagctgtaattaatgcagctcaggaaaatgggattaaaattcctgaagagatggaagttgtaggaatgttgaacacaagttattcaattatgtgtaagccaacactatcttcgatgaatgttcctgtctatgatatgggagcgcttgcagtgcgtttattgacaaagtttttgcatgaagaaaagattgaatctaaggaaatcgttgtccagcacatgtttataaagcgtgattcaacaaatgaataaaagtatttacagcataattatttatgctgtttttttgttgattatattaaaaggaaaatatttttaaaatgggcaatgttttttaagaattattatattataagtagcatatatttgatagataggttaaaattaaattatcaaatagatggaggaaaataatatgatcattacaacaacaaatcaaattgaaggtaaaaaagtagttgactataggggaatagtttttggtgaagtaatttctggagtaaatatgtttaaagatattggagctggaattagaaatatttttggtggtcgcagtgctggatacgaagaagaattaatggcttgtcgccaggaagctttaaaagaaatggaagaaagagctaaggcagcgggtgctaatgctgtaattggagttgatattgactatgaaatgttaggtgctggtaatgatatgatgatggttacagcaagtggtacagctgttgtcgtagaataatatcaaataatgaaggttgacttatcctttgttttagaatataattcaattacgacgttgaaggaaaatagtaatcaaaataggcatttaagagaccttgtggctggtgaaaacaaggatgtactactgatgaatacactctggagtttctagatgcaaagtctagacgggtcatcccgttatcgatttaagagcatgtagtaatacatgaataaaggtggtaccgcgagatttcgtcctttaggatgagatcttttttattttatagatggaggatagaagatgaagatttatgatgaattagtatggcgaggattgatcaaagatgttagttcgccggatctagaagaaaaattaaataatggtgggatgactttttatattggaactgatccaactggagacagtttacatattggacatttttcatcatttttaatttcaaaacgtttaaaggaagcaggacataatccaattttattagttggtggagccacaggattgatcggggatccaaaaccagatactgaaagaccaatgattacgaaagaaacagttgaacataactttgcttgtttaaaaaaacaggctcaggacttatttggatttgaagtagttaataactatgactggtctaaagatttaaatttcattgattttcttagagattatggtaaatactttaatgtcaattatatgttgaataaagatattgttaaacggcgtctagatgccggaatcacatataccgaattttcttatatgatcatgcaagcaatggattttgaatggttatataataataaaaactgtgttatgcaggttgcaggtcaagatcaatggggcaatattacagcaggaattgaattgattagaaaaaaagacggtaaagaagcttatggttttacaatgccgcttttaactaaaagtgatggaacaaagtttggtaagacaaatggcaaagctatttggttagataaagaaaaaacatcaccttatgaaatgtatcagttctttattaactcagaggatgataaagtaatcgattatttaaaattcttaactttcttaacacctgaagaaattatggaattagaagaaaagaataaaacccagcctcatttacgagaagcccaccaggcgctagctcgtgaagtaatcacattcttacatggtaaagaggcttatgaagaagctgtaaatatttctaaaatgttattttcaggtcaaattcaatctttgactttagaacaagttaaagtatgttttgaaggagtgccaagtgttgaaataaatgaagatttaaatattttagatgctttgattacttgtggggcagctaaaagtaaacgcgaagcacgtgaatttgttaatggtggatcaattttaattaatggtgaaagaatcaaagatgttgaatttactgtttgcaaagctaatgcttttggtaatgaagcaacggtaattcgtcgtggtaaaaagaactattttgtaattaaacatgtttaaaagtggacataacgtccactttttcacactttattcacaattgtgaatttatttttctttaggtgtttttttccaaagtaatgtatttttctcgttcgataaactagtcaataaattacttttggcttgaggatatttttggtacaactcatttaataactgtttaaattcttcgcgcttagtatgtttatcagctgggcaggttgatgtcacaacaggaatatgagcttcttctacagctgaaatgatatctgattcataagcataaactaaaggccgaatgaaattcatttcggttcgcgttagatacattttaggggtaaaagtagcgattttaccaccgtagaccatattcataaataaagtttctacagcatcatcaccatgatgagcaaaagcaactttgttacaaccatacttttttgcgccatcaataactaaagcttttttaaactttgaacaaagcgaacattgtaaacgaccatcttcagttttatttaactttaagatttcataaacatcgctaggttcatgatataattcgatctgattctttttacaaaaagcatctacttcactaaaatccatatctggaaagcccatttcaatatgaacaccaactacctcgaatttaacacgggcaaatttttgatacagcgataagcagtataaaagtaacgttgaatcttttccgcctgatacaccgacacaaactttatcaccatcttgaattaaatcaaattcttcatcagcttttcttatacagcctaatacttttttcattgtcatttataatcaccgtcttctattttaacaaaattatgaatatatgcaaagatatttgcattttattacaaacctttgtaaaatgataagcggtgataaaaatggatggaatcgtattaataaacaaacctgcagggatgacgagtcatgatgtcgttaataaacttcgtaaaatattacatactaaaaaagtagggcattgtggaactttagaccctgatgcaactggtgttttagttgtatgtattaataaagcaactaaagtattacagtttttaactagtgaaagtaaagaatatgtcgcaaccttaaatttaggtgtaagtacggatacgtatgatgctagtggtaaagtcttagaaactaaagaatatcaaaaaatagatgatgataaaattattgcttgtttaaagagttttataggaaaacaggaacaaaaaccacctttatattcagcaatcaaaattaagggcaaaaaattatatgaatatgcaagaagtggtgaaaatgtagaagttcctactagagttgttacaattgattatatcgatgttttagaaatcaaagaaaatttgattaaatttaaagttggctgttctaaaggaacttatattcgttcattatgttttgatatagctgctaaattaggctatcctggacatatgcaagatctgatcagaacgaaatcaggtaagtttgctttaaatgactgttttactttagaagaaattgaagctggtaagttcaattgtttaagtattgaaactgccttaagtgactttaaacaattagaagtagaagatgaaaatatcgtttatcatggtaagaagatcaaatctgatctcaatgagcaggtcgtgatcgtaaatagaaataagaaggttttagcagtgtatggccctgatggtaatggttatttaaagaatataagaggattatggtaatggaaataatatatttaaatgaacaaaatgatttgaagatggaacctagttgtgttgcgcttggcttttttgatggttttcacttagggcatttaaagttagttaatgaagttattaaggttgcaaaaagagataatttaaaaaaggcgctgttgacattcgatgttcagcctcgagcttatttaactaatcagccgtttaaatatttaatgagtttagaagacaaaattaatttattaaaatcatatgattttgattatttatttattttacgttttaatcacgatatcgctaaattgatgccagaaaaatttattcaagaatttattatcaaatctaaaatcaaacatgttgtttgtgggtatgatttccattttggcgatcgaggtcgtggtaatagcgaaattttacaagcttatggacataatgattatcaagtaactgtaattgaaaaactggaatacgatcatcataaaatatcttcaagttacttaagagagcttttaactaagggtgatgtcgagctggcagctaaattattaagtcgtccttattgtataagtggtaaagtgatatatggacggcaaaatggacgtaagattggttttccaactgctaatatcgatgctaaagattatttgttaccggaaaatggggtgtatggcgcaaaagtctattttaaagataaagtttatttaggaatggtcaatatcggttataatcctacttttacagcattaccaggattatctttagaagtaaatatttttgattttgatgaaaatatttatggacaagttttaacagttgcttttattaagaaaattagaatggaaaagaagtttgctagtgttgaagggttgattgaacagttaaagcatgatcgtcaacagatcaaaaatgaaataattttgtagatatagttaatgtatctacatttttagttttaaagttttttagatggatatactaatagtggtgatataatgtatgtctggttaatttttgcaagttttttatggggaaccaatgttttagtaatgagatatatgctggaatatatgtcgacatatgatctggcgacacttaaggtttttctttcaatcgtagcgatttttttagtgatgaaatataagaaagtgaaatttaagcgtcgtcatgattttttaggctttaaagttgccttattttcaataacaataaattttattttaacttttgagggcttgaatttaattagcggcagtgctaatgcaatcatgaattcactggctccgttagtaacgattcttttagctttattgatatataaaaataagatcgttaaaaatcaattgcttgctatgatgatagcttttgtagctttttttgtttcgattgattttaaattgaatcagctttcttgggggcatttgatgctacttgggggaattgttttttatagttatggtaatttattgatgcagcataattgtaaaaaagaagagaatctgtcgtttacattagagtatttgagttatggttttatccagttattactgatatcgttattttttccgcaacataacgatatcgaaaatatttcgttaatgttatggctcgtttttattcttttttctgggattggatttgccatcatccagttgatttattttaatgccgttcatgaaatcggtagtataaaaactagttttttactgggattaaatccaatctttacgtatcttggctctttgttgctgcaagaagagtttgcttttaataagatgttggcgatgatcttgatggttatagcaatgttgattgccaataaacataatctatttgtaaaaaaagatagctgagctatctttgataatatttaattagagcttgcgttcctagatcttcatcaccattaacttgtaaagtctcaaacatttttaaaacaacattaagtacttcaaggtcaaggctgttgctatcatttacatccttggctattttcatatctttgatataatgtttgatgtaaaaaccagggtcgaaatcatttgtcagcattttaggaccattgttacttaactgccaagaaccagcagctccactagagatacactgtaacattaattcaggatccaagtcaacgcttttagcgtatgtgatggcttcacaggtactggctaatgcaccagctagggcaatttgattagccattttagtatgctgaccgtttccaggagctccgacataattgagattagttcctaaaacttttaagacaggttttactttttcaaaaacttctttgtcaccaccgaccataatagataaggttcctttgatggctccaatatcgccaccagaaactgggcaatctaagctaacaacgcctttttttattgcttcagtatatatttttttagctaataggggacttgacgtcgtaaaatcaattaaaatagtattttcttttacactattaatgattcctttttcactaaaatatacttcttcaacatcattaggaaaaccaaccatcgtcataataatatctttatctttgcagcattcttcaatactatcacaccatttgatcttatcacttataatatcttcaactttatgtttgcttcgagtaaatatggagatatcataatctgctttacatagattcaataccatcgctttacccattactccaacaccgataaatccaatttttttcatctatttttcctccagtaaatcattaaataattttaaaagtctttgttgtattttatcattattcttttctggatgccactgtactgcgataattttatctttttcgatcccttcaattatattatcaacacttttagcgctaatgataaaaccatcggcaactttatcgagggcttgatgatggaaagaatttgtcataaatttatcacctaaatactttgatagtaaagaatttttacaggtggtaactaaatgacgatagccctgcatttctttttgcatgtgcaaatttgagtcaaggtcttgaatcaaggttccgccaaaagcaacgttaatagtttggatgccgcggcaaattcctaaaatcggtttgttttgctggaaaaacattttaattaacgtaaattctagttcttcaagttcgaaaagctcttttttagttttgggatgtaaactttcgtgatagtaagcagggtcgacatcgagaccgcctgtaagtaatagaccatcacaattatcaactaaaaactgtaaggtcgcaaaacttgcaggagcaattgtaatgatatcaagattggcttttttgaacattttaatatattcatgatagatataaaaaactctgtttggattatatgaacgcagtggcgctaagatttttttattcattcatgtaacctcctattaatatatattattgagaaagaaaataatgtaaatgattatgaaaaattgtcgattctgtttagacatgactggtatgttgtggtatactctataagtaagctttatgtaaagagggatgtacagatggaatttttagataatatattaaaaaaatttggtagtcaaaatgtaatcatagcttgtgtctgtgtgttagtgataattattggtacgatagtttatcgtgcgattaagttaaagatgtatcgtaaagaaataattgaacttgaaaatcgcatgaatgcaatcaaaacattaccgattcagtatcgtttaggtagagtaaaaggaattggaaaaaacatgcctgaagtacttgaaaaatatgaattatatgaatctgaatttaataaattaaatgtttttcaaaataatgatattatgcctttaataaacgaaatagatgaacagcttttttatcgtaaattaacaggtgctcgtaagaaaatagttaaattgaaaaatgaaattgataattatgaaaacaaagctcaagatttgttgaaaaaaatcgaagttattacggaaattgaaaatgttcaacgagttgcaattattaaaatcaaagaaaaatatcgagctgcaagtgataattttgcggctgttagatttaagatcgaggattttgttccagcgattcccgctattttcgatgatattgatagtcgttttgtttctttggaagatatgatgaataatcagcgttttgatgaagcagaatcatttgctgctaaaatcgaaaaagatattgatttattagcagctaatcttagagatttaccaacttatatttcaattgtccggaaatatattcctaagcgtttagaagagttatatgcaattatcgaagatatgaaggaaaaggacttttcaattgaaaaattaaatgcttcagtgcgctataataagattcatgctgatttagaaaatactattcaagctattaaagatctaagattagagaacgttggttcttcgattgaagtaatgactgatgaattaaatggactgggagctgatttggaaaaagaacaggctgcttgtaatcagtatgaagaagcgcgtaataattgttatcgacatattggtcgtttagacgatgggcttaaacgaacagtaaattctttagctgaattacaacgtaattatttattgagtgattataatattacaattgatgaagattataagaattttaaaccaattatagatgatttagaagaaataacgacagtaattgagtcaaaagatttttcgtatagtacgttgattgaagaattcgatcaattagtaaagcgttgtcagccatttgatgatgcgttagtaaaatacaatgaattagaaaattcattaagattacaggaaaaaagagctttagatgaattggataatattaatatcgttctcttagaaataaaatcagaaattaaaaataaacacttaccaatgatcaatgaatcgtataaagattatattgatgattcttatcaaaaagctgatgaaatcttaaagtttattcgtcatcggccaattgacttagaaagattgtcactccaagttgatgcggctcgtgatgtgatttataaattatatgataatgttcataatttgatcgttactgcagaaatggttgaagaggcaattatttatggtaatcggtatcgtagttcttttttagaagttaataccgagttgactaaagcggagttattatttagaaatggtgagtatacaaaagctttatctacagctgttgatataattgaaaagataaatccggggtcatatgagatgttgattaataaaaacacaaagtcggtgtaggactttgtgttttaattgcatataataaaatagggggttatttatgatatatttagattatgtagcaacgacaccgttaaatcctgaggttttaacgacttaccataatttattagaaaaatatttttataatgctgattcaatttatgataaaggaatcgaagttaatcgcttgatggaacattctcgcaagttagtaagtgaaatgcttaaggttaaagaagatgaagttatttttaccagctgtggcagtgaagctaataatatggcaattaaaggaacagcgttccaatatcaaaatcgtggtaagcatattattacaacggcaattgaacattcatcggtatatgaaacttgtaaagaattagaaaaggtttttggttttgaagtcacatatttagatgttgatcaaaaaggctgtatttctttacaacagttacaagacagcattagagatgatacgattcttgtttcgatcatgtatgtaaataatgagattggggtaattaatccgattgaagaaattaaaaaaattgtaaaaaaacatgataaagttaaacttcattttgatatggttcaggctttaggaaaattgccaatcaatttagaagatgtagatttggcctcattttcggctcataaaatttatgggttaaaaggaagcggattattatttaaacgtcgttccacaactatcgtaccattgataagcggtggtcagcaggaatttggacttcgtggtggaacttcaaatgcctgcagtaatattgttttagcaaaaacattacgcttagcattagaaaattttgatgctaaaactaaacatattgatatcattaacaaatatgctagagaatgtctacaacaaataccaggaattgtcattaatagtgatgaatcgtgttgtatttcatcaatattaaatttttcttgtccgggatataaaccagaagttattttacatgatctagagactaaagaaatatatttatcgacccgcagtgcctgttcttcaaaaacgagcaatgtttctagaatcatggcgcaattgcatcttgatgatgtgattgcttcaagtgcacttagaattagttttagtgaacatacaacaaaagaagatattgaccagttttgttattatttacaagacagtttaggaaaattaaagaaacagaggtagaaaatggaagcaaattatatattagttcgctttggtgaacttactacaaaaggtaaaaatcgaaaattatttacaaatcgtcttttaaaaaatacaaaagaaatattgaatgattttaaacagttaagctatgatttacagcatgatcgcatgtatgtgattctaaatggtgctgatcatcaagctgtttgtgataagttaaaaacagtttttggaatctattctttttctgttgcatataaaattgataaagatctagaaatggcaaaaaaagctgtaatgcaaataattgaaaaaaatgatgggaatacttttaagatcaataccaagcgttctgataagaattttcctggttcttctcaagaaataaaccgagaaattgcaggatatgtttttcatcatacgaccaaaaagttaaaagttgatgttcatcatccggaaatcttagttacggttgagattcgttatgatgcaatttatgtaatggataatattattaaaggtgctggtggatatccagttggcgttggtggtaaagccttgttaatgatgtctgggggaattgattcgccagtagcgggttatttgactttaaaacgtggcgtcgatcttgaatgtattcattttgcagcaccaccatatacaaatgaattggcacgagaaaaagtttttgatttaatagataaattacgtcattatacccatgggaaaattaaagttcatgttgttaattttactaaattgcaattagcagtttatgataactgtgatgaaagttatgctatgacagtaatgcgtagaatgatgtatcgtattagtgaaatgatcgctaataaaaataattgtctggctttggttaatggtgaaagtattgggcaagtagcttcacaaactttaaacagcatgcaggttattaatgaggttgttaaaattcctgtattaagaccagttttatgtttagataaattggaaattattgatattgcaaataaaatcgatacttatgaaatatcgattcgacctcatgaagattgttgtacgatctttacacctaaagctcctgcaactaaaccaaaaagttataaagcagaagcttttgaagaaaattttgattttaaaaaattaattgatgagtgtgttgataatgttgaggaaattgtcgtagataatagctataaacaaaataatgaaattttttaaaaaatgatgtatatatttttagctttgacacaagatatatgtgtcaggaggtgaagatatatgtcacaaaactctagtagaaacaaattagttgtccctggagctcaaaatgcaatcgatcaaatgaaatacgaaattgcaaacgaatttggcgttaatttaggtcctgatacaactgctcgtgaaaacggttctgtcggtggcgaaattacgaaaagattagtcgagatgggacaaaaacaaatgagttcatcaaatcgttataatcaatctaaatagttgataaaaccctagttaagctagggttttaacgtatttttgcgtttaataaaaaggtcaagacattaatcttaaccttcattttatattaaaatcattcttcatctggattgatttcaactgataaatgataatggttttgattgaaattttccataattgcatcccaatctccattttcataaagttctttattttctgaaataaaagaatctgtaacatcttctcctttatctgaatcgatgatttttacaccatattcatttttattaaaagcatctttaagatatttggttgtattaggataagaatttgaattcccatcgataatcgcacatactataactgaaaccattgaaatcacaaaaattgctacaataatagttccttttgatattttcataaactactctctttcaattaaaaattaaactatttggaattgtgaatttatcataatatagacccattccactgttattgccaaattgttcatcataaactagaaatgaaaaattactataagtgacttttcttttattagttgcaacagttttactatatgttaatttaatatcacttacgtttccagaggtaagggatatatatggattaccaatgttagtatattgtccgattgcatcattaaatgtacagacagcttttacttttccaccaaactcatttgctgtttttctaccattatattctaaaattttataaatccagccgctttctttggaaactgattgaaaaacatgtggtgctggctttgttgtattaacactacttatagatagcagtaaaactactaaaattaataatgtactacaaaaattcttattcaattgttttaaagttttcatttttctccatcccgtgacttccacttgctaccttttattattttgcaaaacaaattataaagaaagtactctctattattagaatactgatacgaagtacaaaagtcaagcaatacatattttggtatttttttacccattagattcataaatttatttttaacaaatttacaaaaatagaaataatttatgtggtaggaagtagaaatattataacttataagtcatctatgagagctttatttatcaggaaaattaataaatataagcagcttaaaaattaggtgctctattcatattacatataaaaaagaagtaaattttatttttttagaataatatataataaaagatataagaatttatttacttttaaaaatttcccaaaaaggtataaaatgtataatttgcacattttatccgtatttaataattaatatttttgatgaacttatttgagttcatcaaatcgttatagttaatttagctaagcttttagttagtttattaaaaattttaaattaaaatgcataatttaaaattaatgacacaaaataattgtgtcaggaggtgaaaatatatgtcacaaagtaactctagcagaaacaaattagttgttcctggagctcaaaatgcaattgatcaaatgaagtatgaaattgcaaacgaatttggcgttaatttaggtcctgatacaactgctcgtgcgaatggttctgttggtggcgaaatcacaaaaagattagttgccatgggacaatctcaaatgagttcatctaattacaatcaatcaaaataattattttaaaaccctagcttaactagggttttaaattgtcaagaaaaataaaatcggtttaaaatttgaaagcgcttctaaaaaaatgttgagtttgctcaataatttaggtacaatataaaagatgacagaactaaggaggaattatagatggtaaaagtaatggctataaatgcaggaagttcttctttgaaattccagttaattaatatgccaagtgaagaagttattacttctggaatagttgaaagaattggtctagaacaaggtaactttgaaatgaaatataatggtgaaaaatacactaaagaatgcccaatcaaagatcatagtgtggcagtacagttattattagaagcattagtagatcaaaaagtagtaaatagtttagatgaaatcgatgcttgtggacatcgaatcgttcatggtggtgaatattttagtgactcggtaaaagtagatgatgatgttgttcgtaaggttgaagaattagctgaattagcaccgcttcacaatccagctcatatcattggttataatgcttttaaagaagctttaccaggcgtagaacatgtgtttgtttttgatacagcattccatcaaacattagatcgagaaagatatttatatcctttacctttagagtattatgaagatttaaaagtgcgtaaatatggagctcatggtacgagccataaatatgtttctcaagtcgctaatgagatgttaggtaatcctaaacattcaagaattattgtttgtcacttaggaaatggcgctagtatttcagctgttcaagatggcgtatgtattgatacttcaatgggctttacacctttagctggagttatgatgggaactcgctgtggtgatgtggatccttcaatcatgccttatttatgtaaaaaattaaataagacacctgatgaagtattagatatttataataagaaatcaggaatgttaggtatttctggaatctcttcagattcacgggatattgaaaatgctttatttaaagatggtgatgaacgtgctttattaactagtttattatatgcaagaatcgtttcaaaatatattggaagttattttgtagaaatgggtggtgttgatgcgattgcatttacagctggagttggcgaaaatgcagcttatttgcgtcgtttgatcattgataatatttcacgtgctttaggagctttcttggatgaaaaagcaaatgaagtaagaagcaaagaaaatcgtgtgatttcaaatcaattttctcaggtggaagtatatgtaattccaactaatgaagaagtgatgattgctcgagatacagtaaatattttaggactatagtcaataaaggttattgaaattgttcaataaccttttataatagcgatgatattttatagggaggctgatcatggataaatatttagaaataagggcaatgtttgaaaatagggaagataaagaaaatgctcttgcaatggcaaaatatatgcgtaacaatttcaagttttatggacttccaacgcctaaaagaaaagaaatatataaaagttttctcaaagatgaaaagaaaaataaaataatagattgggattttttagataaatgttatgaagatgaacatcgcgaatttcaatatcttgtatgtgattatttaaatgctatgataaaatatttaacttatgaagatatttttaaaataaagaaatatcttaaatcaaaacagtggtgggatacgatagactttttagataaagttattggaaaaataggtttgcgagataatcgcgttgatgatttaatgttaaaatggtctaaagatgaggatttttggatcagaagactggcaatcgatcatcaattgtgtcgaaaagaaaaaacaaagatagaattattagaacaaataatagttaataattttggtagtaatgagttttttattaataaggctattggctggagtttaagggattattctaaaacaaatcctgattgggtcagaaattttattagtaaatataaagataaaatggataagttaagtataaaagaagcaagtaaatatatttagtaaagtagatgaaaaaagaggcattgaacagttcaatgcttcctttttgtaattctaactagtgttcgtttataaaatctgtaataattttgcagtttctttaatattagtacaaatggcaggatgtttgctggtttgaaaaaatatattcagtaattagaaacaagttgatttatttgattgaatttttctttaagatttcatttatctttctaatctgatttttgatctgcaaggcaaaataacagttttatatcttactgttactctaaagtccaaattcccataactttcttatttaactgtatttttaaacaaagaatgataataatattatattgtagtcaagcatccatcataataaaataaggcaaaaaatcctttttgtttatctttatataaaaatgtgttatagtcatatgtaattaaggagtgagaaaatggataaagaaattattgagaagatagaagagtatgattatattgctatctaccgccatgtaaatcctgactttgatgcttttggaagtcagtttggtatgtatgatataattaaaaccacatatccagataaaaaaatttatgtttgtggtgattttagctcagaattagtaggaaagtacacagttgctgttaattataatgaagttgattataataatgatgtattaggaatagttttagataccgctaatagggaaagaatcgatgatgaaaattatcaaagatgtaaagaacttattaaaatcgatcatcacatcgttgttgatagctatggcgttataaactatgaagatagtacagctagttcagcgagtcaattagtgagtcgcttatataaagataatgatgttttaaaaatatctcaagatggcgctgccgctttgtatttgggaatcgttggcgatacagcaagatttttatatcaaaatactgatgttagaacttttgaagctgctagtgcgctgttaaagacaggaatcgatattgtagaattatataatcgcatttatttaaaaaatgctaaagaattagaagttaataagtttattttaaataattataaatttgatggcggtgttgcttattatgttttaacaaatgatgatttgaaaaaactaggaatcagtagagaacgaggatcagattttgttaatgttttatcaggtgttatcgaatataaaatttggctagcaataacggaaaatgttgctgataataattggcgagttagtattcgatctcgagattttgctattaatgaagtagctaaaaagtatcatggtggtggtcatgctctagccagtggagcaaaattaaattctatcgagatgctgccaaaattaattgaagatttaaaggagcttataaatgaataaattaaatgaaatatttgccaattttgttgagggatttacaactcatcgacaacaaaatattgtcaatgaaccgagtaaaggagcttttattaaagccttgatcataacattaatagtaggattgatcagtgaatatctattattgattcccttaaattttcgttctccgcagtttattatttatttttgttttttattacttatttttaatggaatctattctgttttaagtcgcggttttaataaaattattaagtatagcttaattttagtgggtattttagtaatttatgtagctgggggaacctttgttagttcaccagtctttaacgctaaaagttatcaaaaacagttgacccttgataaaaaagcagatttttacgatgataataagacgatttcttatcagtcgattcccgttgttgatcgtgatagtgccattaaattaggggatcgtaagatgggtgagatggtagattatgtttcccaatttgatgtcgatgaatcatatgaacagattaattacaaggataatccttatcgggttacaccgcttgaatatagtgatttaatcaagtggtttactaatcgcagtgatggcttgcctgcttatattagagttaatatggttagccaggaatctgaagttgttaagttaaaagaaggaatgaaatattctaaatcggagcattttggtagaaagatcgagcggcatttacgagctaattatcctactttgatgttcgatacgctggcttttgaaattgatgatgatggcataccatactggattgctccagtatatgagtataaaatcggggtttttggtggtaaggatattactggggctgtacttgttaatgcaatcgatggcgatcataaatattatgatattaaaaaggttcctgaatgggtcgaccgtgtttatcctgctgatcttgtattgacgcagttagaaaattatggaaaatatactaatggttattttaatactttgctttctcaaaaaggcgttttacaacctactgatgggtataactatgtagctatcaatgatgatgtttatttatatacaggcttgacttcagtatctaaagatgcttcaaatgtcggctttgcaatgatcaatttaagaactaaagaaagtaaatattataatatttctggagctgaagaatattcggcaatgtcatcggctgaggggcaagtccaaaatcttaagtataaagctactttcccgatcttgatcaatgctggaggacagccaacatatttcttatcattaaaagatgatgctaatttagttaaaaaatatgcttttgttagtgttgaaaattatcagatcgttgctactggcgatagtgtcgctcaggctgaacaggcatattatgctttgcttgaatctaatggaaaaaaagccgatactggtgattttgaaacaaataaattaacgggtgctattagtgcaatcagtgaggctgtagttgatggaaatagtacgtattattttaagattgaaggtagtgagacggtttttattggtgatattagtttaagtaatcgttttcctcttgctaaaacaggtgatatcgtaacgattgagtttgtaaatagtaaagatgatagtgaagtaattacttcaattgaatttaattaggcagaaaactgtagttttctgcttttttgctgggggtttgactatatttacaaaataaattatgttataatcttacaatgaattgaggtgttgatgatgaaaccaagagtgctggtagttgatgatgaaagagatattagagaattaattggcttttatttaaataaagaaggttttgaaatgctggaagctagtaatggtgaagaagctttagaaatctttgaaaatgaatatattgatttaggaattattgatgtgatgatgccggtaatggatggctttgagttagttgaaaacttaaaggagtttaaagatgttccggtaattatgttgactgctaagggtgaaagtaaagataaattgagaggcttttcagttggggctgatgattatgtagttaaaccatttgatccaacggaattgatggcgcgtgtaagagcggtattgaaaagatatagtgtcaatacatcaaatattattaaattgaatgatgtcgaatttgatggtgaaaaatatgaaattcgttatcttgatgaaacgattcatttgccattgaaacaatttgaattagtttttgaattagctaaacatcctgatcaaatatttagtagagagcagttgattgaaaaaatatggggaatggactacgatggctttgatcgaacagtagatgttcatattaagcggattcgtgaaaacttaggacatttaccgggatttaaagttgttacggtaagaggtctagggtataaggtagaagttgaatgatgaaatcaatttatgggaagttgatttgcggctttttaattacgatcgtttttagtttttcagttgctggatatgttgctttgagaagtaattatgatcaaattgaggatatggctaaaagtgaacttaatgcgacgagtgaatatgtagttggaattttaaataatttagatgataataatattaatgatatcatgaatcaatatgcgattagttctgaggtcaatattacattgttttcacctagttatggctattatgcatatggtgatggtaaatattcaccatctaaagaaacgatgacaaaatattattatgatagtagtaaaaatggttgctatgatgtccgtaaaaatattcaatcgtatggtagtaaaactaatataaaagatatggatgtatatgtatatgtccaaaaagatacaagttatgaaaagggaatttttgcaaattcggcagtattgattttaggatgtgtatttttatcaggaaatattgtttttatcgctattgctgatattattgttaaaccgattacccgtttaactaaagcgactaaagaattgtcaaaagggaattataatgttagggtaaattatgttggtgatgatgagatctcgcgtttaaatcaagggtttaatcaaatggctcagcagcttgctaaacaggaagagacacgacagaaattcatttcagatatttctcatgaatttcagacgcctttaacagctatccagggctttgccaatatcttaaaagaagaggatctgcctaaagagcagcgacaaaaatatgccgatattattttatttcattctaaacgactttcgacattatctaaaaatatgttgcagttgacgttgttggaacgagaagaagttgatttggaatttacaactttttcaatagttgatcaattgacaagagttatttcaactcaagaaaatcaggctattttaaaagatattgaaattgtatttgaaaaaccccggaaaaatattatggtatacggtgatgagcagcgtttagaacaggtttggatcaatattatatctaatgctatcaaatataccgataaaggcgggttgattacgattggaatcaaaaagtcatctcgtgatgttgaagtctctattgaagatactggtcacggaatgtcaaaagaagttatttcgcatatttttgaacggttttatcgtgaagaaaaagctcgttctgttgaaggtaatggtttaggtctttcaatcgttaaatcaataattgatttgcatcatggtaagatagatgttatctcacaggttgatgttggatctacttttattgttaaattgccaagtgaaagaaaatcttttgatctaaaagaaaaattatcgttaaataggaaggattaaagatggatttattaaaacagagaattttaaaagatggaaatgtgattatgccggatattttaagagttgatagctttttgaatcatcaaatagactgctcattatatcggaaaattgctaaagaatttaaagaacgttttaaagatgtcaagataaataaaattttaacaattgaagcttcaggaatcggaattgctttagctacggcttttgaatttgatgatgtgccagtagtctttgctaaaaaagggacagctaaaacgactagtacccacttatacacagcgaaagtccattcatttaccaaaggaatcgattatgatgcaatcgttagtaaaaaatatcttagtgaagatgataatattttgatcattgatgatttcttggcaaatggacaagctgttttaggattgatcaatattattgatcaggcaaaagcaaacgttgctggagttggaatcgtaattgaaaaagggtttcaggatggtcgcagattaattgaagaaaaaggatatcgggtagaatctttagcaatcgttgatgcttttaaagatggaacggtaattttaagataatgaaaagagggtataaatgtatttaaaaagaattgaattgcatggttttaaatcatttgccgataaagttaacgtcgaatttcagccgggaatcaccggaatcgtgggacctaatggctgtggtaaatcaaatatttcagatgccgttagatgggtactgggcgaacagtcagtaaaatcattgcggggatcaaatatggcggatgttatttttgctggaagcgaagatcgtcgagcccaaaatttagctgaagtaactttagtctttgataatagtgatcgttttatgaaatatgattataatgaagttgaaattaccagacggctttatcgtcaaaataatgaagctgaatatttgatcaacaaacagcagtgtcgtttaaaagatattgttgatttgatcatggatactggtttaggaagagattctttatcgattatctcgcaagggaatatttcgagttttgctgatagtaagccggaagaaagaagaggtatttttgaagaagcagctggtgtttctaaatataaaaaacggaagttagaatcgattcgtaaattagaaagaactaaagagaatcttgaaagaattggtgatattgttgtcgaattggaaaagcaggttggtcctttaaagcggcaaaaagaaaaagctgaaaagtatttgactttaaaagagcgcttaacttcgatcgaggtaaatgttttgatccatgagataagtaatgctaaaaaatcactggatgaatttagtaaaagtattaaagatctaaatgaacgacaagtatcattagaaacagatatccagttaaaagaagatagtaatgataagatcaaaaaaaagatgtttgttttagatcaagaaataaatgttttacaaacaaaactgttagaggctgtatctaatgtttctaagttagaaacagctaaagtggaaattgatcaaaaaagaaagcatgctttagaaacattaagtaaagaaaatctccaagaaagcattgctaatatgaaagctattttaagtgatattgtcaatgaatataacgatcgtgtggaacgattagaaaatactgaaaaagaattaaatgagatcattgaaaatcaggaaaatcgcaatgatcgattgactaaattaaaggaagatattgattatcttactagtgagatcaacaaaaacaaatcaaaaaaagagattttgatcgatgcggttgaaaacaaatctaattatcatcacggcatcaaaacagtactatcacttgccaaaagcaataaaaatattattggtgttttaggtgatttaattactacaaatgaaggatacgaactggcgatttcttcagcattagctggagcaattgaattcattgtcacaactgatgatctaacagctcgtgatacgatcaagtttttacgtgataacaaagctggacgagcaacatttttaccagtaaatacaatgaaaccgcgcagtgttcgggaagaacatttaattgttagtaagacgatggatggttatcttggtctagcaagtgattttgttggttatgatgataaaattgaaagtgttgttttaaatcagttaggtaatatcattattgctaaagatattgattgtgctaatgaaatcagtaaagcaacttttgctcgatataaaatcgtgtcacttgacggtgatatcgtcaatgttggcggatctttgacaggaggaagttttaatcgtcaaaaatcatcattggtgcaaaaaagggaacttgaagaagttgctgttactttagaaaatcaagaaaaagattatgctaaaaaaagaaatgagtataatgttttagataatgaaatcaaagaaatttcacatactttgttacaaaagcagatggcttatgctaaattggaagtagttgttcaaggtaagcgcgaagagctgatcaaagcaaaatctgaatatgagtcattagctgatcaaagcgttgaattagaagattttgctactggtaagacagaaagtaaattgatcaatcagttaaatgaagctgttaaatatcgtgatgatttgactgaagaaatcaaatcaaagcgggaacttagaatgtcttatgtaaatcaaaatgaagctttagaagtagaacttcgcgaatatcgtaaagatctaaaagaggtgcaaagtgaagttaacgctaatgctattaaagcgacaaaattggaaacaatgcttaatagtcatttgacacgtttgaatgatgaatatcgaatgacttatgaatatgccgttgaacagtatcaagaagaaattgatgttgaacaggcaaaattagaagtatacgaattaagaactaagatcagtagattagggaatgttaatattgatgccatcgaagagtataaaactgtaagtgaacgttatgaaaatatgaatcgtcagcgaattgatttattacaggctcaagatagtattttagaggctataaaagagatggatgagatcatgatcgaacgtttttcagaaacttttgaaaaaataaatgaagaatttaatactgtatttagaagtttatttggaggcggaaaggctaaaataaagtatagtgatccgactaatattttagaaacaggaattgatatcgatgttcagccacctggtaaggcagtccaaaatatttcactattttcaggtggtgagaaagctttgatcgctatttcgtgtctatttgcaattttgcgagttagaccaataccaatgtgtatcttagatgaggttgaagcagcattagatattgcaaatgttgaaagatttgcgaaatatctaaaagaattttctggaacaacgcaatttattgttgtaacgcatcgtgaaggaacaatggaagaatgtgatcttttatatggtgcaacgatgcagcaaaaaggagttacgaagttagttagtgttaaattagaagaagcgattgatttatctgatccaagttaggagggatttgaaatgggattttttagtaaagttaaagaaaagtttgtcggaaaatcagctaaacaaaatgaaaaatatgtcgctgggttagatcggtctaatacaactttttccgatcgaatcaatgagttggctgcaagatttagggaaatcaacgatgagtattttgaagaattagaaaatattttgatcatgtcagacgttggggtttcgatggtaatgaaaattgttgaagaaatcaagaacgaagtccgcattcaaaatattacggatcctaaagaaatcaatgagatcattgtcgataaaatgtttgttatttatgctaatgatagtgtcatgacaacaaagataaactatgctaatgatggtttaacagttattttaatggttggtgtcaatggtgctggaaagacgacaacgattggcaaattggcaaatcggatagttaaagatgaaggtaaaaaagttatggttgctgctggcgatacatttagagcaggagctattgaccagttagcagtatgggctagtcgagttggtgtcgaaatcgttaaagggcgtgaaggtggtgacccttcagccgttgtttttgatgctttaaaacaagctaaagaaaaaaatatcgatgttttgatctgcgatacggcaggacgcttacaaaataaggtcaatttaatgaaagaattagagaaaatgaatcgtattattaagcgtgaagtgcctgaagcaccgcatgaaactttattagttattgatgctacgacaggacaaaatggggttagccaggcagttgagttttcaaagatcaccgatgtgacgggtctagttttaacaaagatggatggaacggctaaaggtggaattgttttatcgatcaaagatcaattaaatataccagttaaatttattggtttaggtgaaaaggttgatgatttgcaagaatttgatctagatcagtatatttatggattatgtaagaatctagttgaggaataatgatggagtctagtttagagaaaaagcagcgagtaaatttgttgatggattgttatagtgatttattaacagagaagcagcagatgtatttagattactattatcatgatgattattcactttcggagattgcggaggctttgaatgttagtcgtaatgcggtttttgataatttgaaaaaagcagtgcatttattagaaaattatgaagaaaagttacaattattgaaaaaacatcaagaaagacttgacttaattcaaagaattgaagatgatatgtcttgtgaacataaaaaaatagaagaatacttagatttgttaaggaagatatagaaaggggtatttatggcttttgattcattatcagaacgtctgcagagtactttaaagaaagtttctggacaagggcgtttaacagaaaaaaatatggaagagatgctaaccgagattcgtttagcattattggaagcagatgttaactttcaagttgtcaaagagtttatcgcttcaactaaagagaaggctttaggacaggacgttttagggtcattaaaaccaggtcaagttgttgtaaagatcgtccatgatgaattagtagaattgttagggacaacagtagcgacaattgattttaataaaaaaccaacagttatcatgatggttggtttacagggttctggtaaaaccactacagctggtaagatcgctaatttaattagtaaaaagcatggtaaaaaaccattattggtagctgctgatatttatcgtcctgcagcagtcgatcagttgaaaacattaggagaacagctaaatgttcctgtgtatgaaaaaggaacttcacagtcagctgagtcgatcgtacaagaagcaatgcgttttgcgcgagaaaataataatgatgtaattattattgatacggctggtcgtttacatattgatgagccattaatgaaagagttatcaaatattaaagaaattgctcatcctcatgaaattttattagtagttgatgctcttactgggcaagatatcgttaatgttgctagttcatttaatgaacagttaaatattactggggcagtattgacaaaattagatggggactctcgtggtgggggtgctttatcgattagacatattactcatgtaccaatcaagtttattggtactggtgaaaagttagatgcaatcgatttattctatcctgatcgtatggcagatcgtattttaggaatgggagatgtcgtttcattagtagaaaaagttcaagatgtatacgatgaaaaagatacaatgaaagcatataaaagaatgcagtcaggtcaattcggtcttgatgatatgctttcacaaatgcagcagttaagaaaactaggaccactttctggggtcttaaaaatgattcctggaatgcctaagattcctaaattaaatgatgaagattctgatcgtaaattaaaagaaactgagtcaattattttttcgatgaccaaacaggaacgtcgcgatcctagtattatcactttatcgcgtaaagaaagaattgcaaaaggatgcggtaaagatgttgcagcgataaatcgtttattgaaacagtttgaagaatctaagaaaatgatgaagatgctaggtaactttgatcctaatacagggatgccaacgcatggtaaacctaaaaatcctaatacgtttaatcctaatcgtaaaaaagtacgtcataaaaagaaaaagaaaaaataaaatatttgtcgttaatagccttttaaggctattttttgttggataaaatttatttgtatttaacgcatttttttgactattgattgaagaattgctaaaatatatgtacaagcccttttaaatttgcttgtagaatggaggagataaggatgaaaaggggaaagtttttagctggtatactatcactgtcaatgattttatccattgtggtaccaattaatgctgcttcttcaagagtagaagagttactagctaatatgacattgcgtcaaaaagtgacgcaaatgttgatggttgattttaggtattgggatacggacctgtctgatggtgagcaaacaacaggtaatgaatttactaaaatgaattcacaggtccaaaaagttgttgaagattatgattttggagcagttatttattttgctcaaaatattgttgaaacagaacaatcttttgagctatcacaagctttacaagaagctgctactaaagacggtggaatcccactaatcattagtgcggatcaagaaggtggttctgtttatcgtctaggttctggaactgctttacctggaaatatggctttaggagcaactggaagtgttgaatatgcacaggcagcaggagaaattattggtagtgaattgagtgttttaggaatcaatacaaatttagctcctgttgttgatgttaataacaatgcaaacaatcctgtcattggacttcgctcatatagtgatgatgctgagctagtaggaacattggcttcagcaacgatcaaaggattggctgattataatgttattggttgtgccaaacatttccctgggcatggtgatacagcaaccgattctcattacggattacctgtagttgataaatctaaagaggaattattggaaaatgaattaaaaccatatgaagttgctattgatcaaggaattgaaatgatcatgacagcccatattttatatccacaattagatgatactaaggtcttttcaaacaaaacgggtcaagaagaatctctacctgcaacaatgtctaaaaagattttgactgatttattaaaaggtgaaatgggatttgacggaattgtatgtactgatgcaatgaatatggctggtgtttcagctatctatgatcaagtgcaagctgttaaagttgcaattgcagctggtgttgatatgatttgtatgccatgtacattatacaatttagatgatttaaaagatttagatgcgataatcgatggtgttgttgcagctgttgaaagcggtgagattcctgaatcacgtcttgatgatgctgttacaagaattttaactgttaaagaaaacagaggaattttagattatgatgctaatgattattcattagaaaaagccttggctacagttggttctgatgcaaacagagaattagaacgagaaatttcagcagcagctgttacagttatcaaaaacgaaaataatacattacctttaaatattactgaaaattcaaaagttttaatgttatgtccttatgataatgaaaaagcacagatggtaatggcatggaatcgggcaaaagaggctggtttagtacctgatggtgctgaatgtaaagtttatcgatttgcaaatgcaacaattaacgctgaacttcaaggattattagattgggctgatacagttatcattaattctgaagtatcgtcagcggcgagaatggcttatgatcattggttatctgcagctcctaataattatgtaaattattgtcatgaaaataataaaacatctattatcatgtctgttgataaaccatatgatgtgcagttatatccaaatgctgatgcaatattagctgtttatggatgtaaaggttcttctgttgatgtaactgaagcattagttggtggaatcacttcagataaggcagcttatggtcctaacattattgcaggaatcgaagttgctttaggaacatttggagcaacaggaaaattacctgttaatattccagaatttgataattctaataacacatatactgataatattgtttatcctagaggatatggattaacttatgattcacttttagataaaactgaagcagataaaacagcattatcgattgctgttgaaatggctaatgatattactgaagagcagttagataaagtagttccagtagtagtaacagaatttaaggcagcattagctgaagctacaaatattttagctgataaaaacgcaactcaagctacggttgatgcttcttttgcacggttatcaggtgtaatgcaaatgttaggatttgaaaaaggtgataagagtgagctagaagcattgatcaattctgtagaaaaatatgcagaagaaaattatacagctgattcatggtctgcatttaaagcagcattagaaacagctaacgaagtaatggcaaatgaaaatgctttacaagaagttgtagatgaagcatataataatttacaatctgcaatcgacggtttagttaaagcagttaaagtagataaaacagcattacaaatagctgttgatacagcaaatacattaaaagctcaaggagctttagaaaatgtaattcctctagtagtaacagaatttaatgctgcattggctgaaggtactgatgttttagctgatgataatgcaactcaaactgcagttgatgctgccttctatcgtttagctaatgcaattcatatgttagatttcattaaaggtgacaaaacagcattaaatgctttgatcgaagaagctgaaaagtatcaagaagatgactatactacagattcatggtctgtattcaaagaagctttagaagctgcaaaagaagtagcagctgatgaaaatgctttagaagctgatgttaatgaagcgttaaataacttaaaagatgccatgacaaacttagtaatcaaagtagataaaacaagattacaagaagcatatgacaaagtaaatgccttagataagagtgtatatacagaaggaagtgttgccaacttaacagagccgatggcaaatgctaaagcggtattagatgatccagatgcaacacaagcagaagtagatagtgcttataaagctttaattgaagcttatttagacttaagattgattccaaacaaggatctattacaaggattgatcaataaagctgagacactaaatgcagctaattatagtgctaagacatggtcagtggtggcagaagcattagatgaagccaaagcagtattaaatgatccagaagcaactcaagaacaagtagatagtgctaaagatgttttaacaaaagcgatggccggattagaagcaagtaatccagtcaaaactggtgataaaacagcaagtacaagtgtagctactggtgatgatagtttaattggtgtctttgctggagttggattgttaagcatggcagctgctctagtaagctatagaagaaaagaagattaatagggcgtttagatattttcttctaaaaaataattaaatatataaggtgtcaagtaaaaaagcttggcacctttaaaattattattatattaaaaggaaatataaatagcagtaaaattgagattgatcaaaatggatgttaaaaggtttctttcgatagaattgttgcagattcaagagataaatatttttgtctgcatcttttatcaatgcaatacatatgaacagaaaatattaattaagtataatgtaagtggaatgtaaacaacatgagtggtatagatggtaataagttagtatgctataatgtgattgtaataatgaagtttagtaaaagaacatataaatctattgttctagacttttatataaatttattaatagattattagttaagttgaaaggaaaaattcatgaaaacagcaatagttgacgataacaaagacttccttttaataataaaaaatgttctaattggcataaataaccagttaaatattacctgctttgaagatggttttactttcttaaagaaagcaatggaatatgaattagtctttttagatatagacatgcctaatattgatggaattacgttatcaaaattactcggcgaacataatattaatatcatatttgttacagcacacgaagaaaaaatgatccaagcatttggcaagaatgttgttggttttgttttaaaagacaacctaaacaatggattaactaaattattaaacaatttaagtatagaagcaaacaaaccttatttaatgcttccaaataagcagactgagataaaaatttattttgaagaaattatgtatatttcatattatttacacgatattaattttcatcttttgaaccaaagagatatagtagttaaaaatagaaatttaaaagattttgaaatactgctaaatagtgattttatgttaattaatcgcagtaccattattaatctagcatacgcagatgattatagaaatggaaatatatatttaatgggaaaaaagctgccggtgagccgaagaagagcaaaagacctgcaaataaaaattatcgaaaggaaattagcacatgttaaaaaatattgatataatcgtatatatattgatgcagacagtgattttgttttctgtttgtttttgttttcaggataattttaatctctcgcttaataaaccaaaaatattattttcatctttaattggatcgattgtttattttatatgttttaagtatttttttataaatatttttatcttagggataattttattaattattttagttggcatattgtatgctattaatttcgaaaagttatatttaattatttttaactcatccataattataattacatatcatattatgttcattattgttagcaggttatctcgttatccgctagatagtatagacataactgattattcactgattatattctcttggctgggaacattgatattatttgttgttacgtactatacttgtaataaaagttttttcatacctaatagcagtaatgcgcttctctttatttttttctcaatatcaatgttattgattgagttgtgctgtttaagtataatgccaaatttttcagattggagcatatataatttttcaatatttattttacttggattattatgtttatttggaattataatttcaaatacattacaaacaatggctaaaaaatttgaaaaagaaaaacaattaaatttaagcaatattttttcaaatatttatcttgatcaatttaaaaaagagaaagacaatttatcaaaaataaggcatgattataaaaatcaattaattgtgatacagcagttaatcgcacaaaataaatatactgaagtacataattatatcaatgatttgacaaatagaatagttgagaaaaagaatatggtctttactaaaaatttaattattgatgcatatataaattatgttattgcagatcacaacgatattaattttaatattgaaagtaataatttatcaggtttcgataatatgacgacagatttattattagtaataatgaatctaatgaataatgctattgaaaatattggtgaagaaaaaaaagttggtgcattttttgtattaaaagatggacagtttattatcaaagtagaaaatacgtgttattttaatccgttattaaagaaaatgaaaacaagcaaatctgataaaaaaaatcatggttacggaatagagataattaaagatattgtggataaatataatggctcatattttaccaattatcaaaatgacatatttgttacatacattatattaaacacaggagaaaactaaatgaaaaaattaatatttagaggtttgttatttacatatattttaatactattaagttttatttatgcacatagcaatttaggtggacttgagggtctttcttacacagaaaagataattaaatgttcaaattttgtgccattttgtaattttggttccccaaaatcactcttgatttcattaattatttatacaccaatagctttattatcaagagatagttttaatatgttaaataagcaaaaagccttttatctatttattattatcctgattatttttatcaaactggtacaagtgttgacattgcgtggatattttgatgtcaatgatattatctttggttttgctggagcagtatttgtatatgaattaattggtgtgatgatttccaggataaataaaagcatcgtttaactttttaacaagtaatcttattattatcttacattttaagatgttacagtaaatgttgaaactagtgataatagcttaattggagtatatacagttgagtatggtcatatttttagaaaatcataaaagaaaatttagaagacaaatagttatttattgtactatcaatttataggtgattttttattaaaagaagaattctaattttattaatatattagatttataaaaaaatgtttagcgtataattataaattagatgttttaaataaaaaggatgaaatgatgtttttttgttgttatgcatgtgtgtgtttatcattatttattaattatgtgaattgagctaaataaatgatataagatttaaaagattaaaaattatataattaaaataaactaaaggtgtcaagtaaaaaagcttgacacctttaaaatgttatgttaaagtgtacaagtaaattaattaggaggaaatataaatggcagtaaaattaagattaatcagaatgggtgctaagaaagctcctttctatagaattgtagcagcagattcaagagctccaagagatggacgttttattgaattattaggaacttataatccttgtactaatcctgcacaagttacaatcaaagaagaagaagtattaaaatggttaaataacggtgcgcaaccatctgatacagttagaaacttattatctaaacaaggaattatgaaaaaatttgctgattcaaaattaggtaagtaattatggattatgctaagattcttaaagatatcgcaattgaattagttgaggataaggaacatttagaagttcgtgaattgccttcgttagaagaaaatgttgttgttttacatgtttattctgcgcaaagtgatattgctagattaatcggacgtaaaggagcaatggctaattcaattagacaattaatgtcagttgctggtcgtaagactaataagaaactagatattaagtttgaatcgtatgaataatgatagatgtgctgagcacatctatttttttggaggtaagatggagaaagttaaggttggaaaaattattggaaaacatggcttaaaaggtgaattgaaaataaggtcaaatagtgattttggtgcggtgagatttaaaaaaggtaattctctttatattcgttatcaaggtgtggatctagagtttgtgatcgtttcatctagaattcataaaggtaattatttggtggcgtttaaagataatcaagatataaatttagttgaaaaatatgttggttcatttgtttatggattaaaagatgatgaattgttagatgaggatgaatatttttatagtgatttgattggtttgcaagtagtaagtttggaaggaaaattaattggtaatgttacttctatttatgataatggacgtcatgatatattgaatgttgatcatcatggtaaaaatgtggctattccttatgtcgatgcttttattaaagatgttgatttagataatcaaataattagagttcagttaattaaagggttaattgatgaagattgatattttgacgttgtttcctgaaatgtttacaggttttctaaatacatcaattataaaaagagctattgataaagagcttgttaaagtaacgttacatgattttagagaattttctaatgataaacacaaacatgttgatgactacccttatggtggtggtcaagggatggtgttgatgtgtgaaccaatagttgagtgtttaaagacaatttgcagtgataaaagtatggttattttaatgtcgccccagggatcaactttaaatcatggcttagcggttgatttgtcgcatcaggaacatctagttattatttgtggacattatgaaggttttgatgaaagaattagaaattatgttgatatggaaatatctataggtgattatgttttaaccggaggcgagcttggcagcatggtcgtaagtgatgctgttattagattactagatggtgcaatcaaggaagatagtcatcaggatgattcttttagtcaggggcttttagagtatcctcagtatactagaccacaatgttatgatggtaatgaagtaccagctgttttattaagtgggcatcatgaaaatattcgtaaatggcgaaaatatcaggctcttaaaaaaacttatttaaaaagaccagatttattacgatcatatcaatttgatgaagaaagtttagaaatgatgaaaaaaattgaaaaaaatgattgatttttactagtgttttctttataatgaaaaagtcgtgagactgcagatgttccgctggttaatcgaatgaacattcaagacaatttttggagaaggagaagagaaatgaatttacaattagtagaacaaattactaaaaaacaattaagaaatgatattcctcaattcaaagcaggggatacattaaaagtatttgtaaaaattaaagaaggtgacaaattccgtgtccaattatttgaaggggtttgtattgcaagaaaaggtagcggtatttctgaaacatttacagtaagaaaaatctcataccaagtaggtgttgaaagaactttcccagttcatacaccaatcattgatcatattgaagtagttaaagttggtaaagtacgtcgtgctaaattacattacttacgtggattatcaggtaaagctgctagaattaaagaagttagaaaataagaaatggttcgccatttctttttttgttataaatattttaaatttaggttaaagatatgtaatattggtatttgaaaataatatcatcttatataaaatgattatttgattggaaaaatggttaaaattatttataatatagatatcgttttaggaggaataatgcatgaatgtagaaattattaatgttggtacagaattattacttggtgaaattgttaataccaatgccgcatatattcaaaaaatgtgtaaagatttaggttttaatgtttattttcaaactactgttggtgataatcctgagcgctttaaacagtgtttagatattgcttttaaacgaggggctgattgtgttattacaacaggtggtttaggaccaacgcaggatgatttaactaaagaactatcagctcaatatttaggattggagttagtatatttagaagatgaagcaaaaaaggttgcagagaaatgtcgatttgtaactacatggggtgaaattcctgaaaacaattttaaacaggcctattttcctaaaggatgctatgtcttagaaaatgaagttggaactgctaatggctgtgtaatgtctcaagatgataaaatgatcgttaatttacctggtccccctaaagagatgaaatatgttgttgatcatgtgttaaaagcttatttaagtcagtataaaaaagatattatctatacttatgattttttaactatgggaattggtgaaagtaaggttgatgaagtgttagaagatttaatcaatcagcaaagcgaagtaagtattgctttgtatgcttcagaagaaacggtgcgtatccgtcttggttgtaaggctggttcaaaggaagctgctgatgaaaaaatgctaccgattaaaaaaaggattgaagctgtaattggcaaatatattattagggagcctaatttaaaagaggctttggctaagatcatgccaacatattttattatttataattgtgataaatttaaattacgtaatggttttagtttaggtgaaaatcatagcgaagaagtactgacaatgacaattgattgtttagatcatcgtttaggtgtgatcgttaaaatcaaacttgaatatttaggtcgtaaagattattttgaagtaccgttattaaaagatccgactttatcatacagtaagttagaatcaaggatcattagtcgggtatatcagtttttaacacagcagagttataattaaggagaaatgaatgcttgaatttagatatgatactcaattattaattgaaggtgaaaatcttgatgaagatgtaattaatgattatattacaaaaaattttaaaggtgattgtttattagcggttggtgatgatgagttgattaaaattcattttcatactaatgaaccatggttgatcttagagtactgtgctactcttggagaaatttatgatattgttattgaggatatggatcgtcagtcaagaggattaaagggttaaaaaatagtttttattgagtcgcattatattaaataatgcggcttttttgaacttatagttaatcgttatttttagcaattaattcaataaacttattagtagcaatagactggctgcgtcttttaggataagcatagccaatactgcgtttaggcaagggctgaatagttttgatttcatgaacgattccttgatttagtagatcttgtgagaattctttaatgacacaagaaatgcctaagccggctcgagcgaagtctaataataggttatgagcacctaattcaatagttggttttaaaagcagacctttttcagcaaaatagttatcaatacggtttcttgtatttgatgatttttctaataagatcagtggctgattagctaattcagcaaatgaataaatatgatcatctaagtttttagagacgaaaatatcatgaacttgaaaacattctttgattacaagggaatcatctttgattggcagatttaaaaagccaatatcaatttgatcggattttaataattcgcgtgtttctaaactagtacgattaataactttaattttgacaccaggatacaactgcttaaatttgacgatatgagcagttaaaaaatattcactaaaagtgtcaccagccccaatgatcaattcaccttcttttaattcatgatagttagaaagctggttttcaactccagtaattaaggcaagagcctgatcgatttgctgatgcagtaattttccttctttggttaaagtaactcctttagaattgcggacaaatagttgaatttgtaattctttttcaatgctgctaatagtttgggatactgcagattgagagataaataagtttctagctgctgtggaaaaggataaagttgtagcagcttcattaaatattttgtattgttctagtttgatatacatataagcactccttatatcataattatgatatattaattttactaatgactaactctataatataatgattaaggaagttagtcaaactgttatattattgatgcaatttgttgtttaattgtatataatgtaatagtaaataagaaaggtgtgaatttgatggctggagtagtcgtagtaggaagtatgtggggagatgaaggtaaaggaaaagttactgattatcttgctcaaaaagctgatgttgtagttcgttatgctggtggaaataatgctgggcatacgattgtttatgatggcaagaaatttgctttgaaattgattccttctggtatttttagtggtcatgaagttattatgggtaatggaatggttgttaatcctaaagcctttttagaagaagttaagtatttagaggatgcgggaattgatactagtaaaattaaaataagcgatcgttgtcatgtgattttaccatatcatttggaaatcgatgctattcaagaaacgcgtaaaggggctaatagcattggtacaacaaaaagaggaattgggcctacttatattgataaatatagtcgtattggtattcggatgggtgagtttattgatgaagaattgtttttagaaagattgaaagaaactttcccaatgaaagtgatggaatatcctgaattagaaggtaaatttacaattgaaggtatttttgaagaatataaagaatacgctaaagttattgcaccgatggtttgtgataccggaatgttgatcgatgaatatttacaagccgataaaaaagttttatttgaaggggctcaaggcgcaatgcttgatattgattatggaacatatccatatgttacaagttctcatccaggtgctaatggtgtatgtgaaggggcaggaattggacctttatatattaaagaagcaattggaattattaaatcatatacaacaagagttggtgccggaccttttccaacagaattgtttgatgaaactggtgatttaattcgtgaacgtggtcatgaatatggaacagtaacccaaagagctagaagaacaggatggtttgatgcggttgtagtaaatcaatcaagaagaatgtcttctttaacaggaattagtttgatgttattagatgttttaagtggttttgaaacccttaagatatgtactgcttataaatataatggtaagatcattcatggtttgccagcgactgtaaaaggaattgaatcagtagaaccagtatatgaagaaatgccaggatggcaggaagatattacaaatgttaaatcatttgaagaattacctgtaaattgtcaaaaatatattagaagaattgaagagttggttcattgtccagttgtcatgttttcagtaggacctgatcgtgaacagactgttgttttaaaagatattgaattttaaggaggaagatgcgtgaaaagagagttagtcattgttattgattttggtggtcaatataatcaattagtagctcgtagggttcgtgaatgtaatgtttattgtgaaatctattcttataaaacggatattgaaaagatcaaagaaatgaatcctaaaggaattatcttaactggtggtcctaatagctgttatttggaagattctccaacatataaaaaggagttatttgaattaggaattccagtattaggtttatgttatggggcgcagttgatgcagcatattttgggtggtaaagttgaaagagctgatgttagagaatatggtaaatctaatttaatcataagtgataaagattctaagttatttaaaggggttcctgaagaatcgatttgctggatgagtcatttcgattatatttctaagattggaccaggttttaaaatcacttcttatacaaaagattgtccggtagcttcttgtgaaaatgctgatcaaaagttatatgcaattcagttccatccagaagtattacatactgaatatgggaaaaatattttatctaactttgttttagatgtatgtaattgtagtggtgactggcgcatggattcatttgttgaagaacaaatcaaagcgattagagaaagagttggtaatggtaaagtattatgtgctttatctgggggtgttgattcttctgttgcagcagtattattatctaaagcaattggaaatcaattaacttgtgtttttgttgatcatggattacttcgtaaaaatgaaggtgatgaggtagaagttgtatttggaccagaagggcaatatgatttaaactttattcgtgttaatgctcaagaaagatattatgcaaaattaaaaggtgttacagaaccagaagctaaacgtaaaattattggtgaagaatttattcgtgtttttgaagaagaagctaaaaagatcggagctgtagatttcttagttcaaggaactatttatccagatgttgttgaaagcggcttaggtggagaatcagcagtaattaaatctcatcataatgtgggcggtttacctgatgctgtagattttaaagaaattattgaaccattacgtgatcttttcaaagacgaagttcgtaaagttggattagaattaggtattcctgaatatttagtctttagacaaccatttccaggaccgggacttggaatcagaattattggtgaagttactggtgaaaaagttaaaatcgttcaagatgctgatgcaatctatagagaagagattgctaaagctggtttagatagatcgattggtcaatattttgcagccttaacaaatatgcgttctgtaggtgttatgggtgatgaaagaacgtatgattatgctgttgcattacgtgcagttaatacaattgatttcatgactgctgaagcagctcaaatcccatatgaagtattaaataaagttatgtctagaattataaatgaagttcgtggagtaaacagagtaatgtatgatattacttcaaaaccaccagggacaatagagttcgaataggagagtaaagcccacaatcccagcatttatgcggggttgcgggctttttctatgtgtcgtgacaatcaaatgacaataattttatatttcagaagcattttcatggctaatgtctgaactactagttttatttaatacatcatctatatgattagaggttttaatgtttgaaagtatagaactatcattttttgtttttatttctaaaggagtggaagtgtcaactttaacctgaattggagattggcaggtagttgatgcggttcgcaaacagctacttccttcaattttgacaggtgctacagggatggatgcaattttatttatattagaaatactttgcctaaaatttttggtcaaagagtctgatatttcggagtaaatttttcctagtgtactgagactttgttgtacagcatcaaatattgctgaattatttttgaaaaattcagagaatgctgttgacagtagtgtaccaatataagaccaagtttcttcggaatatacctgagaatagagattatttatggctaaagatagttgcttatttattatttttaaattttttgtgcatttttcatattcttcagaagtaataaatttattatgagccactttattacggtattctcgcatatcgttaagataatcctttaaatccatttgggaagataggaagtaacgatcccataggctgatttttttgcaagtattaattgcatcaattatggtttgcttatcagtattctctaaatctaaaggtaatagcctttcatagataacacagtcaggagaagtgtaagcatattcgacaaataaaaaatcatataattgtgcaaatgtcatttcatagagtgcctgttcaattaatgaattttgattatttagttttgcctttatttcgttttttaaatcttccgtaaaagattgttcaaaccattgggatttgaggcttatggttagatttacatatataaattctctcattaatctttcaaatttcccaaaacgaggtgccaacttcgcacaataatattcggatgcttcatcgtaggcgtagaatatataaaagtctttcctatggcttcctttttgtatgcatttagttactaaatttaatactttggcatcaatcgaaggcttggaattgtgtgatactgatagataatatatttcgttgtttactccgctacatttataattaatagtatagggaatattattagttttataaacaaacgtgttgttggttatttgttcaaatataaggttgaacatttctttaaatatggattgggcattgggatagttttggtcatttttgacttttctttcgaatatgagatttatttgcatttcattatcctcaaatttacttatttgggtacttacttctccaggctaagtattcctcttccgtaatttcctcgtttctgtatttctggtatatatctgcccattcaccgatttgatctagcatatttaatgaatcatgccctttatccttaaacatcagttgaggtaccccggattcatctctgtaggcatggagtccatactggtcttccagtgcgaatagggaatgcataacacttatataggtatcaaagtttggatcagccagtgcgaatgggctgatttttaatgcattggcaattttttctaattgatcctgggaagcggtgcggttccccagttcataatttcttatagctgactcacttagtccagcctttatggccaattctttttgggtatatccttgttctaaccgatattttctgattttatctccaacagtcataattgatcgctccttcacagttattgtctcttattatagcataaacagttcaaaaatgaaatataaaaacaaaccgttcaatattgaaattattctgttgacatttcgaaaatgaaatgttatgatacaagcgtaccgttcaaaaatgaactgatacaatttataaaaagggaaaggaggaaaaaaatatggcgagcaaattatttatctcagcgaaagaagttgcccgggaattagaagtatctgattcctttgcatatcgtctggtacgcaagttgaacgatgaactggaaaaacagggatttgtggttgttaagggcaaaattagccgtaaatattttgaagaacgtgtttatggtatgagcgaaacaaaataatgtgagagttcaagaaagaaggtgaaaatgaatggcagttattaaaaacaaaaagaccaacacttatgaagttcgcacatattataaggattggacaggtgctagaaagcaaaaaacaaagagaggatttaggcgcaaatgtgatgcgcaagactgggagagggcgttcaaattaaaggaaaatagaagtctggatatgacattcggagattttgtgaatatttatctgaacgatattaaacccaggattaaatataatacctggctgactaaaaagcacattgtcgataagaagattctcccgtattttacggacagaaaactgcaggagatcaagacggcagatatccgtcagtggcagaacatgatcatggatcatagagacgctaacggaaaaggatattcgcaggtgtatcttaagacaatccacaatcaaatgagtgcgattttgaatcatgcggttaacttttatgatttgaaaagtaatgttgcacgtaaggcgggatctatggggagagaaaaatcaaaggaaatgcttttctggacaaaagaagagtatacacagttcattgaagcggttgcagataagcccatatccttttatgtatttgaaattttctattggtgtggattgagaatgggggagcttttagccttaacaccggcagatctggattttcgatcccatactatacgcatcaataaatcttatcagcgcttagagggaaaagatgtcataacagatcctaaaacaccgaaaagtaatcgaattatagtgatgccggagtttttgagtgaagagctagaaagttacttaagtatgctgtatggactgaaggaaacagatcgaatctttcagatttctaaaagttatctccaccatgaaatggatcggggagtaaagctgtcaggtgtcaaacgaatccgtatccatgatctccggcattctcacgtatcgctgctaattaatatgggatattctgctgtggcaattgcagagagagtagggcatgaaagtgttgagattacatatcgatacgcacatttatttcctacgatacagaaagatatggcagacaggttaaatgaggaaagagaggattcatggaatgagtgaaaaaaatatggataaaaagaatcgttggcgtaatgtaacaattgcttttcgaatgtctcctgaagaaaatgaagaactggataagagagtgaaactttgtggatatcaaaccagacaagagtacattattgaaagcgttttatatcaaaagatcaaagctgttggtaatccattgatgctggtgcagtttcgaaagcagctccgagatattgagacagaattaaaacgtctgaacacattgaatgatgcaggagaagaattatttattccgatcagaaccatgttggaaattttgaatggatttgcggaagggagaaatacagatgaaaaccaaaaagatggtcaacaaagtttatgaaatcttgaatcgttctaaaaaattagaaattgcctctatccttgtggattttgagtcagatcatgtggtgttgattgaattgatggatggaagcagatttgagattatagtgattccgacaagacggtttgtttgagaggtggagaaatgggcgctggaaaaaagaaaaagcccagacaaaatatctgagcaagttctctgataatcagatttactgatataccatcttcgcagattaagtatatcacggattgttgttatttagcactttatattaactagaatttatcaaattattttaactggctttttccattattttgactaattagttatgacaatcacactattttacttattcccgtcaaattacgccaactataatttcaatataaaaagatagtaattttgccttttaacagctaattactatcctcttttaatattaaactttatactgtattctctgatgaaaattcaacgttatgcctggtattgtgctatatgagcgcttattatacttaatccttttgctatcgtcaatccatcaataatactgttcatataacaggctattttttcactattccagaaaatatcatccaaactgctaagttcactggatactccaatacctggaatatccagccatctcttcatatcaaagttaattacatatacacgatacctgcttccccttgcgcttactgtaaatccagtaattctatcatcgatacttatatcttttaacacacattgccatgaagtgttcttataattacatatataagttatttttttatccaatctcatttgctgcctccattacaatttcattatcaatagtcattttttctctggcagctcctattattaaacaatgagtcagaagattattgagtttgcgtgatgatccctggcaggcattgctcagtgctttaactgcctctggtaatatcaatggctgtgttcttcctgctttctttagtttttcaatgatgtatctgcctatatcatcttcattcattcctgacatttcatactgaataacgattctctgtttcagtgcttcgtgtacagctcggttgattgtatgattaagcactggagttcctgtcatgatcaaaatgacataattacttgaatcaaaattaaagttaagaagcatgatcagatcattgagaatagctgtctttaaatattgtgcttcatccaggatgatgacaggtatgatccttttttcatcaactgtacttttaatatagttttgtatatttctgaagttgtctatttttttatgcattggttcaagtcccaactgactgcacagttcacgatagaattcaatcgtcgtaagtgttgacataggcatataaacaactttataaagtccaggattcagcgattcactaaaacttttcataattccctccatttccgtccgccttcgtcggtcagacacaaacattttattaaaaataattctcatccaatcgtttttgtagtatcctataagagaggtggtatactacagagcacgtggaggagagtaggcaattctactctatatagaatatcctgaataattataagtcgccgtcagtctttcaagcacaaacaagtaggacttagagcctggacacttaagattgtttttatcaactatagtgatattttgcagactgacagtcaatgccacttctccttttttgaaaggagtttttttatgcttaaaatccaccgttttaattgtgctggtcttgatgttcacaagaaccttatcgtcgctaccattggtatcactgacaagaaaactcatgtcactgaatatattcagaaagatttctcttctcttaactttgacctctataatcttaaaaactggcttattgaacacgaatgttttgatgtctgcatggaatccactggtaagtattggttccctgtctttaatgtccttgagactgaagctaaaatgaatattgttcttgtccatcctaaatatgtcaaagctatcaagggcaagaaaacagacaagaaagattccaaatggatttgtgatcttttcaagcatgatcttctcaaatcttcttttatcccgcctaaggatattcgtgaattaagggatctctctcgttatcgttttaagctcatctgtatgagaactagtgaacgtaaccgttatcagaactccatgactgtttccaatattggtttggcttctgttgtttctgatacttttggaaaaacagcccaggccgtcatgaatgaagttctatctactgaagttattgatgaagataaaatcacaaaacttattcatggtaagtgcaaaaacaaagataaaatagttgaatctcttaaaagttcaaaaattgagccagatcaaagatttaaaatggcagaaattcaatcacatatgaatgaacttaatcaacatattgaagctgttgaagtagaaatcatcaaacgtgcttccagatactttgatgattttttacatattacagaaatagatggaatacagcttatgtctgccattcttatcatttctgaaattggcgttgatatgactcaatttgaaacagataagcaactatgctgctgggctggactttctcctgccaataatgaaagtgcaggaaagaagaaatcagttcgtatcaacaaagctggacaatatcttaaaccagtattagtacaatgtgcattggcagctatcaaaaacaaaaacagttattttggtcaaaaatatacaaaaatcaagaaaagaagaggacacaagaaagcaatcatagctattgcaaggatgatgcttgtcagtatttatcatatgattcttactggagaaaagttcaatccttcagactatgaatcatttaagaatccaaagccacaaaaagaaaagaacaattatacagttgagacagcacttgattttctaaaatcacagggatttgatgtatcaacaattcaagatattcctaaataatattctgttttttctaaataaaactgaacttgtttttaagttcgtctttttttgtgtttttactcacgattgggttcaattatttttcacacttgtcttccctgtaccacttcttccagtaaaaagtccaatgcccctgatatctttgagatagttgagtcttcctattgcttctttaaagtcatctgtatctatttctatatctggctgtcccttttcaaagggattgaattccatcccatagtatatcttgaaatctttcatagctgttcctcctgtgcaaataaaggcctttttcgttttattcttgaattatcaacctttctgacctcatatatttcgatatagctgtcattttcatatatgaaaacatgacttagatcagggacatatttaattgtgactcttgttccaatatattcctgttttgtttcatagatctttgtattgagtctaatcgttgcatcattgatgacttttctagtaactgtatgatagaatattttttccagctgctgacgatcgatcctctttatcatatgggaatcattcataaatacatttacaggcgtctgcccattcaaagcggcatgtggtgaattgtttttctgattgacatatataccaaaagctttatcgatatcatcaattgttttgaattgggagaaatctgtattgtacatccactgttcttttaccgatttgaaagctcgctccacttttcctttttgattgccatgataaactttggcatggcttatttggatttgcagctgagcacagatgataggcagttgttcatttttataaggagaaccattatcagtaaatatccttttcggtatgccaaatttaccaatagccctttttaaaacagtctgtacattaacggcattgtcttccagaaaaaatccatagccaacgatcattcttgagcgatcgtcaatgatcatgatcagataggtccttaacttacgaccgtttttattagtgatataagaacagtaggtcgtatccaattgccacatgtcgttggcatgttccatttcaaaggcacgcatatcttcgacaggaaggcgattcagttctggccttgaagcaatgaatctcgatactgttgaaagtgaaacatcctttttcagaatatcaccatcctctattagcttcagatagacagaggtcgctgtcattctcggattgtcggtttttagtttgattattttttctttgatgcactttgtaagcttgcgagaagttcctttatctccacgtattttaggcataagtccatcaaaaccatacttgcgatacagatcgtaccagtaacgaatggtttgaaaagagaattctttagatgttccatcaggatactgaaagggagtagaagaaattctcttataatactgcaaggcagaacggtcaggataggtttcgttgagaacgggaatgatctgttcatacctgaaaagagcgatctgcatatttaaatcttctttttttacattattcatatagaatatacctcctgacataaccatataacacctatatcaggtattcaaaggaaacgttatgggaaaaagcaatcatgaataaatgatcatatttttcgtcaggatacgttgcataaacatggtatgatactctgcaaaatagctgatgatgaaatcaaaactgaggagatcacatgaagaaaagacactcaaaaaagaatcgagacgttccttgtgatattttagataaaagatgataagctttctgacaagttctattgaaaaaccagtgagtttggaaataacagaaatagaatcattggtattgcgaaaagaagtgataatcctgataatattaggattagacaggatgcggtaagggacaatgatgctgggaagaagtgcatgagtacagttgcagctttgacatttgatacgtgtaatagttaattgaacagtatcatttacatcaacctgcaaataacgagtgtaggtcgcatggttgtgaaaatgtccaacagagccacaagtgcatctgatatgggaataatttatttttttaatatcttctttataagagttttgatcatatttattgataaaagttgtttgaaatgataacatatagattgtaaaacatacgttttattttagaaaaagaaaggcaggagggcgatccaatgaccctttctttttttgtatgtcagctcctttatataataataaaatagttaaaataatttgcctatcattttatcaaattattttaactatttttctatgtttattatttttgtttgactaaatagctgttattttaattaaaataatccaccgaataacagattgtaagatacgacaattcccaattatctgttcatcagagacttgcccggaagggcaggaggtgaagtagatagaattgaagacgatagaaaataagaaggcagaatggaaaagatcagagccggagctgaaattgatcaacatggaatcggtgaaagtggaacagattgaatggctgttgtatccgtttattccttttgggaaagttacgatcatacaaggggatccaggagagggaaaaacaacgatggttcttcagattattgctaaactgaccagaggagaaccaatcttgttgaacaagaaatcccaaaaagaagcacagcaatatagcgaagagaatctgaaacaggaagtgttatcgcaagataaccctatacagcctgtcaatgttatttatcagacggcagaggatggattgggggatacgataaaacctcgtctgcttgcggctggggccgattgttccagagtgctggtcatcgatgatcgagaacagccattaactatggtggatgtccggcttgaggaagcaatcatgcaaacgaaagcaagaatggtggtgctggatcctatacagggatttctaggaacagatgtggatatgcatcgagccaatgaaatccgtccgttgatgaagcggatggcagtccttgcagagaaatatcattgtgcgattattttgatcggtcatatgaataaaaacagcaatgggaaatcttcttatcgtggccttggatccattgattttcaagctgcggcaagaagtgtcctgatcgtggggaggttgaaggacgaaccggagacaagggtaatgtgccatgtgaaaagttcccttgcaccggaaggaaaatccgtcgcattccgattagacaaagaaacaggatttcagtggagtggagagtatgatatcagtgcagatgaccttttgagtggagatgcaagaggacaaaaaagtcggatagcgaaggaatttctgttggatattttggctgatggcggtatggcacagaaaaagatcgaggaagaagcgagcaaacagggaatcaagaagaaaactctgcggaatgcaaaacaggaactggagatcgattcggtcaaacggggaaaccaatggttttggatattatcagaataaaggaagatggcaaggtgaccatatcttaagaatagggcatcttgccaccttgaaaggagaagtgtatggaaataaaaaatgtacagattccatttacattatttcgtcagcttgtctcgtatcatttactggatgattacagttgttcagatgagatatgtaagggacttgaagaaaagatggatcatctggtcaatagacaattgtatacgcagtccaaaacagcagcgacggaagaagagcgggaaaaagccagaaaggagtatctggataagaaaggaatacaggagaactttcgttggtagggattcttcttgtttgagttataacaggagcgtggcacgcacctgtaaatcacggacgaagagaagaatcagatgatgcagacggaaggatatcgctgaacggaaacagccccgcagggcgcaagggtacttttgatggacgaaggctgtcgaaagtgcttttgcgttacttttgacaaaagtaacaaaacttgacgtatccggcataactagattatgtgccgtgtccggcaccataggaaagataggaggtgagcaatggcagaaattaagaggactatcagtggaatgtcagggaagggttcgattgcccataatgaaagaagatttattgcggaaaatgtggatcgggaacgaacatgcgaaaatgtcacgttagtttcggaaaatatcaaagatgtctatcacgaattatttgatgcagctttagggagatataatgcaaaacaaaaaaggaaggacaggatgatcgaagattattatgaacacatccgtctgggaaaacaggagaagcttttccatgaggtgatctttcaaattgggaataaagataatatggcatgtcagagtatggaaggggaaatagccaaagaaatcctgctcgagtttgccaaagagtttcaaaaaagaaatccgcagctacgtgtatttggaatttatcttcatatggatgaagccacacctcatctacatatagattttgtaccttatatgactggaagtaagagaggtttggatacgagagtatctatgaaacaggcgttagcatcaagaggatttgtcagtaagggaagagaagaaacagaacgtgatcaatggatgttgtctgaaaaacaagagctggcaaaggttgctgaaagatatggtgtgatttgggagcagaaaggtactcatgaagaacatctggatgtgttgaattttaagaagaaaaagcgtagagaagagattgcagtactggaaaaccagattcaggataagcagcatgaaatggaaagattagaagattcaaaaatttcaaagatcggtgaacttcaggatttagaagaagagaagcggatacttcaaagtgaaaatgcggactataaagaaatatctgaacaacgattaaacgatctggaaatgattgaggagaggatccaggaaataagtgctgaaaagaaaaaaaaggagcaagatgctgaaaaagctttacaaacagcactgaaacaggaaaaaagattggagaaagccacgactattgcacgggacattactaggtatgccggagaattctctaaatcagtagatgaaatcgttcctgatccaacggtgttggagagtgctaaaacttaccgaaagaataaagttattcctgtgtttcttaagctccgcaacttgctatatggactttatatggcatatatccggattaaggaacagtcggagcagatacaataccggtatgacagattaaagttatccaatgagaagcttgccaagaaaaatcagtatatggaaaatgagattgacgagtattattgtttaagaagagcgttgggaaatgagcggacggacaatatgataagattacaacggcaattagaagaaaaagagtatattttgagaaaaacaaagaagaaagtatatgggatggatcgataagaggatattgtgactgtaaaatgaaaagggaagataggagagcgggagtagcttgagaaaaagctgctccctcaactttttaatgtgctttgtgagaaggaattttcatgacaaatatgtgatggaatggtataatagttgtaagtgataaatgtaaaatttgctcttatattttagaattggtgagaaactacaagatgaaaaaagaagaacttaagatattatcatttcaagatgcaatggttatgcagagtggaagagaaaaatatgatcagacaaaatggatctatattccggatttttatacagaatatagatatatactaggaacggtaggaaataatccacttattacgattggaattaatccatcaactgcagaaccggaaaagatggacaatacgatgaattcagttgaaaggatagcaatgaggaatggatttgactcatttattatgtttaatgtctatgcacagcggtcaacagatgccaataaaatggataaagaaataaatccgaggcttcacaaagagaatatgcaggcctttcaatggatattggaaaacagtgttgagaaaccggtgatttgggcggcttgggggacaaatattgaaaaaagaaattatttaaaagagtgtcttaaagatatggttaatatagctgatcagcataaagctgtttggtgtaaagtaggaaaatgttctgtaaaaggacatcctcatcatccattatatttgaaaaaagattcaagaatagaagagtttgatatagaaacatatttggctttgttatgagaaaaatagaattggggggatttatatatgcaaaaatggatgatatcggcgaatgggaagatgtatgatcatgcgtcggcatttcaaaaatggggattcattgattggagacaaagagcacactatgaagtgggggatattgtatatatctattgtacaaacccttataaaagagtgatgtataaaacagttgtagaaaagcaatctttgtcagttaatgaaatcgttgatgataaagagtattggtttcaagtagaagagtacgaaaaagctttaggtggaaaatatgctagattaaaattggtagagcaagtggatagtgataagctgtcattggaagagttaaagcagcatggattaaagagcgcaccacaaggaccaattaaagttagtaataatttaggggaatatattgatacatatatgcatgatgattatgctgctggaatattccctgaggaagatcttccagaaaatagctatgaaggtgcagtgaaacagatcattgtaaacaaatatgagagaagttcaattgcaagacaaaaatgtattgaatatcatggatgtaaatgtagtgtctgtggaatggattttgaagagaaatacggagatttaggaaaaggatttatacatgttcatcatattgtgccacttaataagatagggaaagaatatgtggtcgattataaaaacgatttaataccagtatgtcctaattgtcatgcgatgttacatagagtactagatggaaaagaagtatccgtatatgaattgaagaaaattatagataccaggtttatagctgacactgcaaattaaagtgtggagataataaattgtttgtcgattttactatatttgggagaagtttgaaaattattaaataattcggagggagagatataggaaatggaaagtttggtggaaaaattaaactcatataatatattaaacaatttattgcctggagttgttttgggctttttgtttgaaagttgtttgtctgtaacaattattcaaggtaatgtaatagaagatttgtttatttactattttataggaatgattataagtagatttggctctgtcatagtagaaccgttatataaaaagataagattagttcaatttgccgaatatgatgattatataaatgcgagcaaaaaagataaaaaaattgagattttatcagaaactaataatacatatcgctcaatactatcagcatgtattgtaactatattggctaagatatattttgctatttctacaaaagttaatgtattatctaattataaagaagtgttaatattgcttatgtgttgtgttatttttagtattgcatataggaaacaaacacgatatatttttcagcgtattaaaaaaaataataaggaggaaataaaatgagtatagttaaatcgttatctgtagggaacggagatatgttttacataagacatggagcagatagttttaccacaatagattgttgtatgacagacgagaataaaaaagaaattatggatgaaattattaagcaatcaaaagataaaaatatatgcagatttatatcaactcatccagatgatgatcattttcttaatatagaatattacaatgaacgtaaaaaaatagaaaatttttactgtgttcaaaatgaagcatctaaagatattgaaacagattctttcaagaaatataaagaaatcagagatggagataaagcatattatgtatataaaggatgtgcgagaagatggttaaatgaaagcgatgatgaaagaaagggagctggattaaattttttgtggcctgacgttaataatcaagactataaaaaagaactagaaaaagtaaaaaacggggaaagtcctaataaaatttcgttgattttacagtataattgtggagcaaaatttttgtggttgggagatatagaaacagattttttggaaaaggttaaggacgaaatagagtttgaagaagtcgatgtggtttttgcaccacatcacggtagaaatagtggaacggttcccaaggaaattttaaaagtgctaaatccacaaataatagtaataggagaagctgattcggaagatttgaattattacccaggatataatactatcacacaaaattcagcaggtgatataacatttgaatgtgttggcagtaaagtccatatttatgtaggaaaaaataattattctgtggattatttgaatgatgagaataaagcaacgtattcaaattatattggatcatttgatgttagaactaaataaaaagtgaatttcaaaaagtctgacttgcgttttatgtgacaataaaatgacaatattacgaaccgaaaacgcaagtaatatatacaaaacatttcgatattgaactgatatgcgataaaaacattttaagagaattgaaaagcaggaagaactttgcgagtttgaatagtatataaaatgtcaaaaagtccgtattttacgggcttttttaatgccaaaaatttttatgataccaaaatgatactattaatattaccatggtactattcttttgacatagacttttctactctatgagtcattcaaagtggttttgaagtaaaaaagattacagaaaatgtagtaaatctctgataaattatgcttaaaatatggtttgtcagttattaaaaatcctcaatatgtgttaaattcttacatgaaggacattaaaaaagatatggatattctagttcagcaaagtaattttgtagatgtgttttggcacaacatgaagaaaaaaggatatgctcttgaaagaattggagaagaatatgccatttatcattcatattattcagatccaatctttctaaaaaatgttaggggagcaataccattatgaaaatatagaagatagattaaccgataaaagaatacttccacaagaaacggaatacacaaaaagctattatcagtacaaggaatattacaaaaagtataagaaaaaacaactcactggacctgcaggaataagagtaacttatctcatttcattaaatgtcttaccaactcataagcaaaaattatcaaaggaagtaagataagtaataagagaactggatatgtttgtgaaggaaattgaattgttatatcaaaacaaaattgaagatataaaccaattagatgacatcagcaagtgaagcagaatgaactagataagctgaatcatgaacgacaaagctgttattattgtcgaatgaaagctacaagtgtagaggaaaaagaagagtggtcagcaaaaacaaaacaaattacaccagcaattaaaaaagttaagaatggaagtcaaagcctgtgttaatattcgaaatagaagctttaaagatgatgtagaacgtatcggatggaagaaaataagacaaagagaacagtcacgttaggaggaaaaacaaatgaaagaaatgaagtaccaacaagtaggagattacaaatttccagttttaaaacaagaagaatcattacctaatttaataaaatttgaacgaatgtatttgaaacatttgaaagaaaattataaggcacattatctagcttagattgcagaaaataagttgaatgatgaattattattaatagatcaacagatgaatgatagatataatgtattagtaaagcaacttatggaagaaagaaatattaatgaagaactaaaagaaaaagatcaaatgaaatgggtgcaagaaatgaataatattagaaatgcagtaaatgaatttcttataaatgaatacatctatgtgaaatagtataaaaactcgcagatatttgcgagtttttatataaataaatcgaataaaattgtataatataaatgtttagcaggagggtgttatgtcagtttcgtatgataaattatggaaactgttgattgataaaaaaatgagtgcatccgagcttagaaaagaagcggctattgcaccaaatactttaactaaaatgcgaaaagaacaagaagtttctttgtcggttctaggaaaaatttgtgattgtttacaatgtgattttaaagatattattgagtacaaaccgaataaaaatatggataaagtcggtgaggatatctgtgattgatattagtaggtaagatttattagatttatctgaaaaagttgtttaacacgcttttgatggatttaacaacgaatcggcttgtttgatagaaagacaagagttatagatgaaaatacaagtacagaagaatactttaagtggacgaaatggtcgtttgaaaatatttataggtatcaatgccagaaggataatcttttaattaaagggcgaatctgcttttaacaattattaaatataaggaacataaaatttcgaaaaagccaagttcagaacaattacttgtaattgtaaaagtcatttttgaaaatttttgcaaacggatgcaatcactatgcttattcctttttagtgagcggcgaaaagtaaaatcacagataccattgttttatcctgtcggaggagagttcaaattgttcataattatatgctgtctgtgataacaatatatttgtgcaatgtataaaaaaagagaatccatatgatttttccaaatgaaaataagacaacgttgtctgttagcgtaaaaatattttgcaaaagaagttagtgtgtttttttaactgttaatagatggaaaggtagcaaagcccaatctttctgcaatgaagaatataaaaaagttctgctcaaaaaatgatgttaattattcaacatttaaagaagtatggatcgattaaaaaacggaggaaaactaaaatgataaatataagaaaattagaagctgagttatgggaatcagcagatttactcagagcgggttcaaagttaacctctaatcaatactgtatgccggttcttggacttatatttttgcgttatgcgtatagtagatacaaaaaggtagaaacagaaatattgaaggatagaccttctcgtggtggtagagttatgcctgttgaagcaagtgattttgcagcaaaaagtgctttattcttacctaaggaagctcaatatgattatttattgaatttaccggaagatattaaaactgctgaaattaaaaacaaagatggtcatgtcatgaacagcttaggtgaagtggtaaataatgctatgctgttgattgaggatcagagccagcaattagtcggtgttttaccaaaaacatatacagatttctcagatgagattttatctgagcttttgcgtatttttaacaatagtgcacttgataaaataggcggagacatcattggtcgcatttatgagtatttcttaaataaattcgcaaagaatattgcatctgatgacggtgtattcttcactccaaaatcattggttaagatgattgttaatattatagagccgacaagtggtgtgttattagatcccgcttgtggttctggcggtatgtttgttcaatccggtgattttgtaaatcaaacaggaatgaatgcaaacaacgctatgacattttacggtcaagaaaaagtggaatataacgctcagctttgtttaatgaatatggcagtgcatggtttaacaggtgtcattaagtcaggtgatgaagcaaatactttttatcatgatgcacataatttagatggaaaatgcgactacgtcatgtcaaatcctccatttaatgtcgataaagttaaggcagaatcaagcgaaagtgcaaaacgtttaccttttggtatgccaagtgtcaatgataaaaaagaagttggaaatggaaattatctttggatttcatatttctacagctatttgaacgaacatggtcgtgctggatttgttatggcttcttctgcaacagatagccaaggaaaagataaagatattcgagaaaagttgattaaaacaggtgatgtagatgtaatgattagtgtaggtaataacttcttctacacaaaatcgctcccttgttctctttggttctttgataaagctaaaaatgaaaatatcaaagataaagtattgtttattgatgcaagaaattattatacagttgtagatcgtacacttaacgaatggtctaattggcaactaaaaaacatgaatgcaattgtgtggctttatcgtggtgaaatagaaaaatacacccagctcttaaaagaatatcaagaagaacttggttctgataaagcttttgatgaacaaattcatgatttatctaaacaattaaaggaacttcgaaaagaagcaaaaaatgaagttgaaaatgctacacgtaacacaaagaaaaaagttcaagctaaatttgacgaaaaaattgtagaacttgaaaaacgtttgatgattgttaaggaagcaaactggctttatgaaaagttcggtgatggtcaatataaggacatattaggcttatgtaaagtcgcaactatcgaagaaataaaagctaaaggatattcccttactgcgggagcttatgtaggtgttgcaccaattgaagatgacggtgttaattttgaagaacgaatggcagaaatacataaggagttattatctctacagacacaatcaaatgatttaatggaaactatctctcggaatatgaaggagatggggctatgaattggaagaaaataaaattgcaatctctgtatgaagtgcataatggattatcaaaaggaagaaagtattttggaacagggtttcctttcttaagtttctcaactgtttttaacaatttctttataccaaatgaactgttagatttagtacaaacaactcctaaagagcaaaataattattcaatactacgaggggatgtctttgttactagaacgagcgaaacttctgatgaattggggatgagttgtgttgcacttaaagattatccatacgcaacatacaatggttttactaaaagaatgcgtccgattaccgatgaggtgttgccagaatttataggttattatatgagaactccttcttttagaggtgaatttagcgctttctctacaatgactacacgagcaagtcttagaaatgaagatttattaagtttagagattacattacctgatatggaaacacaaataaaaattgctaatgttttaaaatgttttgatgaccttatcgaaaacaaccaaaagcaaataaaacttcttgaagaagctgcacatcgtctttataatgaatggtttatagatttacgtttcccaggatatgaagatacagtgattattgacggtataccagaggggtggaaaaaacaaagaatttcatctttgggagaaataatcacaggaaaaaccccttctacagcaaatgaacaatactatggtgggaatattccttttgttaaaattccagatatgcataattgtgtttatccagttacaacagaagttacactaacagttgaaggtgcaaacacacaaaaaaataagtttattcctaagaatagcgttatggtatcatgtattgctactgtaggattggtaaatattgctatagaaccttgtcaaactaaccaacagattaattctatcatcttaaataaagaacaagatttatattatgtgtattcaacaatgaagcgattaaaagagctacttaaaggagtaggaagtaatggtgctacgatgacaaatgttaacaaaacaaaatttggtaatcttgaagttctttatcctacagaagaattgcgcaaaagatactttgaattttgtgagccattatttaagaaaatacttgctttaactgtgagtaataaaaaactatctcaagctcgtgatcgtttattgccaaaacttatgagtagagaattggaggtgtaattttggaaaatattcaatggatttttgatggaattggaacagaagtaatatcattaattgttggcctaactgtcggtggagtttcagggtataaaattggtgttagaaataaagcacatcagaaacaaaaagcaagagataatgcaactcaaacacaaaaaggaaatatcactataaataattggaaaggtggtaacaagtaatatgagcgataagcaagttcaaaaagcaggagcaaattctcaacaaatacaagctggaactatagtcgttaataacttagggattactgaagaacgtgcacgtgctatttatactgaaatgtctttaaaagctatttcagataatactgttgaatcttttgaaaaagcaaaagaacgaatagaaaaacttgaagctcttgtgataccaagagtcgaatcaattgataaaacttttgagtccttttcagacccagcatttcaagttttattaagaaaggcacaattaactgctgcttgtacagaacgaaatgatgactacaaaatattatcagaattgttggctcatagaattgaaaatagacagaatattaaaaaaagggcaagtatcacaaaagcagtagaaataattgatcaaattgatgacgattcattatgcgctataactgtcctacattccatgaaaagttttgttcctcaaagtggaattatttcagctggattgaccacactttcaggtttatatgaaaaactaaatcttgaaaaccttccaaatgataatttatggattgataatttatcgattcttggagctgttacaataattccattttcaaaattagtaacctttgaagagtatatagcgacaaggttagatggttatgtttgtgtagggattaaaaaagatagtccagaatatcaaagtgctttagaaaaattgaatgaatgtagaataagtaaaaaaatattaattgataacgaattattagatgggtttgttcgtatgcctcttgctacaaaaaatgatatatcagagctgcgtttaataaagaaagagattattgaagaaaaattaatagaagttaatgttccaatgactgagagtcaattgaaatgtctatcgagtatttgggatatgtattcgaaagatgttaatttacaatcgcaagtaaaggttgcctttaatggtttgttacataaatatgaagcaataaaaaaagcatgcaattggtggaattcgataaatgtaagcgtgtctctcacatcagttggcaaagtaattgtgcatacgaatgcaaaaagtatagatgattctttacctgacttagactaaaaggtggtgagtttatgagctatgattattccgaaaatattcttgtgcaagaaagtgcaggaaatttattaaaaaatgaattaggctggaatgtagaatttgcatacaatacggaagttttgggaaaaaatggaacatttggaagagaaaattataatgaaatcctactttctcgttattttcgtgatgccatgaaaaagcttgattcttggataactgaagaacaaattgtcgaagcacaagctgttttggagcatagattgtcatcctcttccattctgcaaatcaatgaggaaaagtattttctaattcgtgatggtattcctgtgactttaaaaaaaccaaacggtcaaacagaaaagaagactgcaaaagttattgattttaaaaatcctgaaaacaatcactttttagcaataaaagaattaaaaattcatggtgatttatatcgtagaagaactgatattgtaggttttgtaaatggcattccgttgctgtttgtagaactgaaaaagaatacagtagatgttcaaaatgcttatgaggataactacacagattatcttgatactattcctcaattattttattataatgcatttttaatactttctaacggtttagaggcaaaggtgggaactttaggtagtaaatttgagttttttcatgagtggaagagacttgcagaagatgaacaaggaaatgttgaacttgaaacaatgcttagaggtatatgcaaaaaagaaaacttccttgatcttttagaaaactttattttgttcgatcactctgatggaagaactgcaaaaatcttagcccgtaatcatcaatatttaggtgtgaatgaagccgtgaaagcatatgcagatagaaagcttaatgatggtaaattaggtgtattttggcatacacaaggatcaggaaaaagttattcaatggtatttttagcaaaaaaaatacgcagaaagtttgaaggctctcctacatttgttgttttaacagatagagaagaattaaacaaacagataagtgatacatttgaaaattgcggattgttgggtaaaactgatgtttctaagttcattgctacaagtggtgatgatttgatatcaaaattaaaaggaaatccaagctttatttttactctaatacagaaatttaataaaagtgatgtagagcctatttatcctagtcacgatattatcatcatgtctgatgaagctcatagaagtcaatatggtatttttgctggtaacatggaaaaattgctacctactgcagctcgtattggttttacaggtacaccactattaaatagtgataatattacagctcgtacttttggtggttatgtatcggtatatgattttaaacgtgcagtggaagatggagctactgttccactttattatgagaatcgtggagaaaagattcttgatttaaaaaatccggaaatatcaaacgaaatattagaagcaattgaaaaggctgatttagatgtagatcagcaagataagttagaaacggaatttgcaaaagaaattcatcttcttactgctgaaccaaggcttagatcaattgcaaaagattttgtacaacattattctgatttatggacaagtggaaaggcgatgtttgtttgcttgaataaagtaacttgtgttcgcatgtataactatgctcaggaatattggaaagaagaaataaaaaatctaaaagcacaaatcaaaaaagcatctcagcaagaagtgcaagaattaaatcgtaaattaaaatggatgcaggaaacggaaatggctgttgttatttctcaagagcaaaatgaaattcaaacatttaaaaaatgggatttggatattaaatttcatcgttctaagatggagaaaagagaacttgataaagaatttaaggattcaaaaaatcctttccgtatcgtgtttgtttgtgcaatgtggcttaccggatttgatgtgaaatctctttcttgtttatacttggataagccattaaaggctcatacacttatgcagacaatcgctcgtgcaaaccgagtaaatgagggaaagagcaatggtttaattattgattatattggaattgtcaaggcgctaaggcaagctttggcagattatactgcaaatgttggtggaaatggtggaactgatccaacgattgataagaaacaattgattgatcgtattcttgaaactattggtaaaacaaaattattcttaaatgatagaggatttgatttacaaatgttgattgatgcgcttgatttcatgaagttatcgtatttgaaagatgcagcagatattgtatgtaacagtatagaggaaaagaaaacatttactacatatgcttctgaattaaatcgtctagtaaaatatcttgatagaaatgatgttgattatgttgtacgaaaagaatatgaggctattgcagctatttatgctcagttaaagaaaaaacataagcatgtagatacaacagacttaatggtagaaataaatgcaattattagtaattatgtggaactgaatcatacaccgatgatggtatgtgaagaatctgttaaatttaatataagtggtattgactttgatttgcttcgtaaagaatttgcaaagacaaagcaaaagaatttagtcatgaaagatttggaggaagttattcagcaaaaactggatagtatgctattctcgaatccaaatcgtattaattattatgagaggtatcaaaagattattgaagattataataatgaaaaagaccgaacaacaatagaaaagacatttttggatttgatgaatcttgctaatagtatgaatgaagaagaaaaacgttatgcaagagaaggattttcgaatgatgaggaattaacgctttatgacatgttgtttagaagtgatttaactaaagaagatattaaaaagttaaaagaagtcgctattgaattattggaaaaaatcaagaaaaaaatatcggaacttgatcattggacagataaacaggaaactaaagctgaagttgataatttgattcgtgatattctttggagagaacttccagaatgttatgacgaacttagtatttcaagttaccgtcaacaaatctatggttatgtttatacaagatatagtgtgatagcttaaacataattttttatgttattagaaagttttcaagaattacaatcgcagttagaaaagaaataaggtggtgaattattacgaaaaataattataaaacattggagacctcagtaagacgaagttatgcaagtgttgtgtggtcgcataagattcaagaaaagcaatgtgatatttatacaaagcaatatagatttttagaaacgctaaatattattgctgcgtctacaacatcagtcggaatattatcattaatatttactaatcaattttggattaaaataatatctgcaattttatcgtttgttacaatatttgtaagtgcttattttaaatcgtttgatttacatcagatgactttaagtaataaaactacagcaaataaactgttatgtattcgtgaccaattatatttaatcattctaaaaatacacatggaatgtgattctgcaaatgatttactaatacagtacgagaaaacacttaaagaattagataaaatatatcaatctgctccgaatactacagataaggcggtaaaattggcaagaaaagctttaaatgtaagtaaagataatacttttaccgaagatgaaataaatgcatttcttcctgatgagctgagaatggagggaaaatatgagtaatttagtttgtaagcatggagaaattataactttagatatcagaactaagatttcgcaaagatatcatactgtcacaaaagcaatcaataaagaattttggaatagttctagcgacactgcaaacagtttatatgttggctcttatggaaggggtacagcaatagatacaagtgatttagacattttagtgtgtctcccagaatcagaatattatcgttatgatgtgatgaaaggcaatggtcaatcaagattgttacaaagtgttaagaatgcaatattaaatgtatatccgagaagtgatgtacgagctgatgggcaagtagtaaaaattaacttttcagatggaatgaagtttgagatattacccgcatttaaggtgtttgattggtttggcaattggacaggaacatataaatatccggatacaaatatgggtggaaattggaaatctacaaatcctaaagctgaacaagatgctatggcaaacaaaaataagagtagtaatggtctgctatatgatacttgtaaacatattcgtagaataagagataatcattttagcagttaccatttatcgggaattgtgattgatagttttgtttataatgctattggaggatggcgatggtctgaacctggaagtacttcttctgcaacaataggttcatatgagcaggttttgattgattattttaatagccaccttttttgggggcttcctataaatgctccggggagcaatgacttagtttctgttgatacgagcattgaatgtttgaaaaaagtacttaactatatgactaaataaaaaatgaccgcatcggaaaaattaatactccagtgaggtcattccattttatgattgttattaacaattgattttgttcaactcctaatttagatttccaaattctagtactttttgagtatagtataaaattaaaaatattttatactatctgagtatacttttacctagttctacagatgtactcagagagtactcattacgggtacatattgagtacaaaaaataaatgcttgtagaataatagaggtatataatataaattagagaaaaatatacatgaaaaactataaaaaagacaggaaatcaattcaaaggaacagagttcgaatagaactaatttaattttatatctaaaatcgtcaaaaaaggcgattttttcttttattacttttataggattttatattgacactcaaaaaggaaactaaataatattacattatttataaacctttaatatgatctttacaactctccaaaaaaatgatctaattattttgaggtggttttgatgaataatgagataattagagatgaattaaaaaatattcaaaataaagtgcagatttataacaataaaaatatttctgaggaaaatgcatttgaatatttaacaatgcaatttttttgctataaaacaaatgagatcgatgaaaagatatttgatattaaaaattcaattactaatggagctaatgatggtggaatagattttgtgttttatgatgaagaagaaatgaaagttattctaggtcaatgtaaatatacagaaaatatgagtttaaatgatgttatttcagaattaaatatgatgagttcaactgtagaaaactttaaaaagggagttacaggatcatataatcaaaaactcaaaagtgttcttcaaaatgctttagatagattaacagaagaaaatgtaggaaatgtagaatattggatttttacaacttctcattttgatgaaaataagttatataataaaattgaaaaagaacacaatttatattcaaaagaaatggtttctgtatttggattagaagatgtttcatcaaagattaaagaaacaattgaaaaaaataaaacagtaccagaatttaaacttaaattagataaagtaaataatgtattaagatatgaaaccaatcaagtatctgggataatggttaatatattatctacatcgttaattagaatgtataatttatataaagatgatggtttattcgatttaaatttaagaaaatatattagaaataaaactgtagatgatggtattaaaaagactttagataaagatagaaataatttttggttctataataacggactaacaatcgcatgtaatgattttgatttagatggaaatatattgaagttatatgatttttcaattattaacggtggtcaaacaacaaatagaataggaaattataaaggaagtaacaatggagagttttacataccttgtaaagtgattaaaattaaaaatgataatctaaaaatgtattcaaaaatagctgaagctactaattcacaaaaaccaattaatgcaagagatttaaaatctaactctccagaaatgaaaatgatccaaaattggttaaaaaatgaaggaatatatttagaaattaaacgaggagagaagaaaaaacaaaaattaagatctataaaaaatgatgaattaggacaattggttttagcttttgcatatcaacaacctggaactgctaggtcaggtaagaaaaatatctttgaaaataattcactatataataaattatataaagtaaattatgaaaaagatcctaataaaaaagcttttattttagatttaattaagttaaatgaagattatttttctattgaaaatgagctaaaaaaaggatctaaaatcaaagatggagataaagtggtacttgctaatggtaaatacataattatgtcattaattggattatcatatttgataataaacgaagattataatagagatgaactaaacaatgatgtaaatctaataaaaaatcctaactttgtttttgggagttttatatctaactataaaaaagatgactataatgaaaaattagagtcgttaatatgtatgatacttgattcactttgcgatacttatgattcatgtataaaagatggttcagtaacaagtgtaagtaatttatttaaaactgaaaaaaagtatagagagcatattgtaatggattttttgaaaacaataaatatgagaagatataaagatgaattcaaagattgctgtgaaatacttaaaagataaacacaatattaaagtataaatatgatattgtttattttaattttataatattaatttgttatcatgactttatcaaaaaagcaatttataaaaatatgagaaaaattgatgttttacaaacaaaaaattttataaaaaggttagaggtatattattctgacagcgaattcgagtagctagaatagttcttagtggtttagaagtatcattaaaagatggcactctttgtgtattaaatggatttagcggagaatcattgaatttgaaagttatagatttttttatttgaatgagtataatataagtgagaggaaactttcatttatattgttattaaatgtacatttggtgcatattaataatgaggtgtttcaacttcaaagcatcctatgatgacgagtgacggttctgactcgtcggtaaaataaaaaatgaccgagcgatgatgatgtgtgagagcaaagacacatcggtaaaataaaaaatggctcaaggatgcaagatagaggaatctataacaggttcctcttatttttttagagaaaaggaggataagtaaagtgcatgattatgaaataaaaaagttgagtgaacaattttataaagattatcctcatgatcaatatcaagaaatattaataaaagaagaaagaaactatgatgttgttttatttgagattgattatttagcagattgttatatatgtgtactatttagaacaaaaatgaaacataataacagatataagtttaaattttctgataggagtaaaaagcatcaatcaggattagatttctctaaacttgttgtttagtaagcgtcaaatagcttactaataaaaaacatggagtaatttgctaatttatataaaaactaatttaaatagattagattatttatattgttaagtgaatttaaataacaacacgtgttaaaaaactgctaatttaatcaatagtttttgtaatttacaagtgtctgtgaaaataaaaattactaaatataaaatggaacaaggatgcaagaaagagtaatttaaaacaatgtcactactattttaaacaggtgatagacataatgttctttagttccattcctttgctaatagaaaatcacggatattacgatgtttgataccatctcggctcatgtcaaattcatccatggacacaacgtatttgggaaagttatctttgatgttatcaaatgctgtaaattcacgctggattgtttcttcagaggcaagtagataagtgacttgaacatatagcttttcatcttttttgtgacatacaaaatcaatttctttgtcacaagttcttccaactgtgactacatattcacgacgaataagttctaaatatacaatgttctctaaagttagattgatttctttcatattgccaccaaatactgcttcacgaataccatgatcagcaatataatatttttcgttagttgcaaggatctgtttaccttgtaagtcttcacgtttaacctgataaaataaataagcatcacaacaatatttaatatagttcaagattgtttctggagctacagtacgatgttcgttttttaaaaactttgctaaagaagatgctgagaatgtatttcctgcattggttattatatatgcaatgatgcgttctagtaaatctacatcacgaattttgttgcgtcttacaatatcttttagctgtacagagttgaataaatcgagaagatattgctttgacggttcatcaacatatcggatatttgcaaggtaaggcatgccaccagacagaagatatttttgaaagcttttttggatagtttcatcaggagcaatcattttatatagttccaaaaattctgcaaaggagaatggatagataacaaattctacataacgtccagcaaggtatgtagcgagctctcctgataatagttttgcattagagccagtgatgtagatgtcacaatttaaagatacacgcagtgaattaatacatttctcccagtcttttacttcttgaatttcatcaaaaaaaagataaaccttaccgtcaatgttagcagctctttttgtgatttcattatgtaaagcttttgctgtctgtaaattagcatagttcatatcttcgaaattgatagagataaactgtgatgaacttataccacactctataagttcttgtttgataagttctaacataacagatttcccacagcgacggatgccggtcataacttttattaattctgttccgataaatggacgaatacgacttatatacatttctcgtttaatcatgaaagaataatcctcctttatattttcaaagaaagtataacatgtttataacttaaaaacaattaagaaaacatattttatcagttataactgataaaatatgaaaaatgataatgtttttaaagtataaatgacgaattttgttaaaaatgtagattttaaggatttaatattagtaagcacatttatgtgttaatacgaagataaaattggaaatttaaattcatatgatacaataatctaaaatgtgataaaatagcaaatcattgttaatcttgacattcttatttataagttaattttaatataatttattcgacaattttattaatcatatccatatgttatgcatattgataaaaatatatcgaaaattgatacaatgaattcattaaaagagtatatatttaatgaagctgaacttaattttcatttattaatattatattgaacttaaaattgatcaaattaaaatttgtatagagagttgaattgaatagatacttaaccttatttatataatctttagcttaattacttagctgttttaagggaatgattatatttttgtaaaatcactttaatcataataacaagtgtttttaccagaacctttttttcaattcatcggatgttactaattttcgtaatgcattttcgataggacttatactaaatgaaggacaaaatccatggatattttgcttagtaaatcggcctatcttattcatagtcgcatgtcttactgtttcaagagcaggaagtttgatttctacaagagcaaatcgttcttcaaaatcattataagctgcaaagatagtgtcaagtaaatatttgataaatggaatagcattcatgccaacaattctgtgcttgagtgagcatcatagtataaatctttgttttacagtttttgcttctaaagaaatatatttacccacatagaatccatttctgtataacaacaatgtagtaagtaagcgactcattctgctattaccatcgttgaaaggataaatacaaagaaaatcatgaataaaaacaggaatagcaattaatgattctatttccatattaccaatgacacggttgtattcttcgcaaattttatctagtgcttctgctgttttatatggagaaaatgaagtgaaaagtgtttccgcatgatccattggatatgttacactgatataattctgtacatttttagtccgacctgccaggggattgtttatatgattatttaaaatcttatggagttgtaaaatataattttgagaaataggaatcacatcaaagctttcatgaatgatgtttaatacatcacggtaacctgcaattttttgttcatcacgatttttaggttttgttttcttttctaccagctttttaatatgagagtttgttgttacaataccttcaatagcattggatgcttctatactttgtatctttacaatcttgaccagtttttctaattcttctgatcgttgtttaagatacattttttgttttccgacttctttatatattgtgactatcaaaccaagaatatcagaattccacttttgattcttaattttagaatagttaaagtctctcattacctcacctccgatatattgtccttaaattatatcgtaaaataagggtaaatctaataatttaagtttttccttaatagtatagctggtttaagggaaaatgttctagaattacataaataatgtgtggattcatcataaaaactaactgtaactgttgtaataatgaataacatgttcagctctatgatcatgacagccacaacgttatttttgtttgtcttaatgtttttagcaggagccatacacatgaaatgattatttatcttccagtagttttaaatgttatcgcttatttgaaattatttggataatgaccaattaaatgactaagtttttcattaacttaaaaaaattatctggtgaaagttaataagaagaaagatatataatttataaggtattaagataaaagattaaaaaaataggtatgtattatctaaaaaaaattaaagcaaaaatcgaaaggttgtaacaaaaagatgtttatgagttactggaaaagtgtactaaagaaattattgttaactttgttgcttattgtagatgttttgattcaggaaacatccgaatcactttatatgatgattgtttaaaagttatatcaccaagaatgttatttcaaagtgttataactacaagaaattcatattataaaaatcttttgaagttattaatttagatattaaattgatttgatttgtattttttgatagttgtggtatactttatttgtagaaaaaatctatttgttgggctggtcgtaagacccgggtccatctattagtgggtaagacacccacttttttataggaaaggataaatgtattttgataaatgaggtaataaaaatgatagataaagaattaatggaattagttgaatcaatacaacaattatatgagcaggcttttatgttttattctccagtagttgaagaattatgtaatagaaatgatgtttcacaaaaagaacttgaatatgaattagatgatatgctttcattttgtcaaagtgatgatatgcttaatttgtttaaaaggctttgtagaaaattttataagcaatatccagaaaatgttgcaagttatatcatgacatataaagattatatgatgaataaaaatagatatttattttattaaaaatactttttatatttgaaaaaaatcttgtcaaatacaaagaaagtatttttttatttataaaaatattttataatattatttaacagatatttgttgatggaggtcgaatatggacatttgttataataaactttttaaaatattgatagataagaatttaaagaagacagaatttgctaaaatggttggtataagtcaaaatacattagcaaagctttctaaaaacgagtttgtatcaatggaagtattagtaaaaatatgcagaggtttgaattgtacagtagatgatatattagatatattaccagaaagtgagagtgatgatagtggcaagcaataatgcaaatatagggtttgaaaaacaaatatgggatgcagcttgtgttttatggggacatatacctgctgctgaatatcgaaaggttatagttggattaatatttctgcgttatatctcaagtgcttttgaaaaaaggtataatgagttggtagaagaaggatatggctttgaagatgatagagatgcctatattgaagagaatgttttctatgttccagaagaagcacgatgggagcatatatcttcatcagcacatactccagaaataggtaaagttattgatgatgctatgagagcaattgaaaaagaaaataaaactttgaagaatgtacttcccaaaaattatgcaagtcaagacctagataaaagagtattaggagatgttgttgatttatttactaatatggatatgggagatacagaagaaagcaaagatttacttggaaggacatatgaatattgtatacaacaatttgcagcatatgaaggagtaaaaggtggtgaattttatacaccatctagtattgttaaaacaattgttgaaattttaaagccatttgataattgtagagtgtatgatccttgttgtggatctggaggtatgtttgttcaaagtgttaagttcttacaagctcatagtggaaacagaaatcgtatttcggtttatggtcaagaatcaaatgctgatacatggaaaatggcaaaaatgaatatggctattagaggaatagaggctaattttggaccatatcatgcagatacattttttgaagatttacatccaactttaaaagcagattttattatggcaaatccacctttcaacttatctaattggggacaagataaactaaaagatgataaacgttggaaatttggtataccacccgctggaaatgccaactttgcttggattcaacatatgatacaccatttagcaccaaatggaaagattggtttagttttggctaatggtgcattatcatctcaaacatcaggtgaaggagaaatacgtaaaaatattatagaggctgatcttattgaaggaatagttgctttacctcctcaattgttttatagtgttacaattccggttactctttggtttatatcaaagaataaaaaacaaaatgggaaaacattattcatagatgctcgtaaaatggggcatatggtagatagaaagcatcgtgattttgatgatgaaaaagacataaaaaaacttgcaaatatatttgaagaatttcaaagcggaacattagaaaatataaaaggtttttgtgctgttgtagaaactgaagaaataaaaaaacaagattatattttaacccctggtagatatgtaggtattgaagaacaagaggatgatggagaaccctttgatgttaaaatgaaacgtctaacttctgaattatctgacatgtttgaaaagtctcatgagttagaagaagaaatacgtaagaagttaggagcaattggatataaattatagagggaaaaaagatggagagatataaaaaaatatttatttattttgatactaattgtttagaaagtagacattctggtaaatctttatatctttcagaacttaaatttagcagattatactatgaaattgaacatttagtaactgaattaggaatttctgatacagtgagaatatgtattcctgaaattgttatacttgaaataaaagaacatttaatttctcattataaaatggaaaaggactctttagaagataagataaaatcatataaacaatcttttggggatttaattgaattaacatattcatttaagagttgtgatagtgtggaaaagtataaaaaatatatagatacaatatttgatgattattttaatgattctaggtttgttgctgaaaaagttgaatttccaaaagatagtaatgttgttacaagaattattcatcaagcgattcgttcaaatagaccttttcatactgtaaagcataacaataaaacatacacagatgcaggattaaaagatgcattaatatataatacaataattgaacatactcaggaaaatataggtatattgatatcaaatgataatgatttcaaaatactttttgacgaaaataagattgataattttcatttgtgtactaatcaggatgaagtagaaagaaagctatatgagttacttgatataagtacaaaagaagtaatggaaaacaaattaaagaataacaattatttaataaatttagtattgaatgaatgtgaatttgataatagtgttgaatataattttataaaaataatagattatcagaaaaatgacgaagatgcttatgatattacttttctaatgtgggtagaggaagaaaaatatgctttttatattggatataatgatgttgcaaatgaactaatacatgtatcttatgatatatatgaggaggacataaatagatgatgatagagctatttaatatttgtgaatatgtacaggaaagaataaaagtagattttttgactaaatataattatatttcaactgataatatgttgccaaatagaggaggaatagattttgcaaattcattgcctcatgttgtaactgtaaaaaagttttgtcaaggtgatgttttgatatctaatataagaccttattttaaaaaaatttggtatgctaaatttgatggaggatgttctaatgatatattagttattagagctaaaaataaagtgctttcagaatttttatattatatattatctagtgataatttttttgaatactccatggcaacttctaaaggtactaaaatgcctaggggagataaatcagctattatgaattacttggttccattagtagatataaatgttcaatataaaataactaatattttatcaatattagataaaaaaatttatataaataaattgataaacaataatttagcagcttaagagatcaatgtcggagacatcaagctcaccggacataagtttaggcaataacgaatcacgaagtcgctctaaacgacagatttcatcgtaattattgcgaatagaggtatccattggagcaactaacgcctcaaattcatcaagcttttcacttgatggtatgaggagaggcatttcatttagcgaatttctgttaattgagccaaacacagtgccttctccattaaaaacatccaactgctttttgagggaaaacattgtgtatagcatgaaagattgatgattattctttgaatgaatagctgcaagtcctcgaccaatacagcaataagtatgagccacatttaagtctccgacaggtgctcgaacactcattaaagtgtcatttacacaagccattcgctttggttcagttgtataaaggcgaacagtcggaaatctgaagccaaattcggcacgaccttggaagaaaatagtgccatttccatcttcattatagctactgccgcttggagactgtcccattgtaatatcggctatgtcgctcaatgtgccttctgtccaatctgagcttgcattatcaataaacatctgctgatatattgcctgagcttgctgctgtaaattattgtttatatatgtaaagctcttgtgagtggcaggagttaataaaagaacaaccactctctatgtgttctcaagaagaggagaatatatatggatgaaattataaaaaatacgatattacaagaaatggttacaagtttagatgatggccaatatgaaaaattaaatcgcatacttgtcaaagtattgtctaattatcaaattgaagagattaaatctgacttaagtgataaaaataatcaatgttatgttgattcgtttctatcagcaaaaagattagagggttgttctgaaaaatctcttaaatattataaatcaaccatcgaaatagtgcttaactcaattaataaatctataaaaaatgttacaactaatgatctaagaaattatttaacaaactatcaagaagaacatggatcaagtagagtaacaattgataacatacgacgcatattatctagtttcttttcttggttagaggatgaagattttattataaaaagtcctgttagaagaatacataaagttaaatcagcttctgttattaaagaaacttatagtgatgaatctttagaattaatgagagataattgtgataatttgcgtgatttagcattgattgatattttagcttcaactggaatgcgtgtaggtgaattagtattattaaataaagatgatattaattttaatgaaagagaatgtgttgtttttggtaaaggtgataaggaacgtattgtttattttgatgctagaacaaaaatacatttgcaaaactatttaaatagtcgaagtgatggcaataaggcattatttgttactttaagaaagccttttaatcgtattactattagcggaatagaaacgagaattagggagatgggaagaaaattagatataaataaggctcatcctcataaatttagaagaacattggcaacaaaggcaatcgataagggaatgcctattgaacaattacaaaaattattaggacatcaaaagattgatacaacattgcaatatgcaatggtaaaacagagcaatgtgaaaattgcacataagaaatatataggatagggggattttcatgaaggattggataacttgtaaactgtcagatttaggtataatagtaggtggagctacaccatcaactaaacaaatgcaaaattatgaaaatggaagtatttcttggataacgccaaaggatctatcctcttttaaagaaagatatattgatagaggagaaagaaatataaccgaattaggattagaaagttgttcaactcaattgattcctaagaattctgtacttttttcttcacgtgcacctattggctatgttgcaattgccaataaggaattatgtactaatcaaggatttaaaagtatagttcctaatgagaacacagattatttatttttatactatctactaaaatataacaaaaaaaatatagaaaatatagggagtggtactacatttaaagaggtttcagcaactgcaatgaagacttttgaagtgaaagttcctaaatcaaaaaatgagcaaagaaaaatagcattaatattagattcaatcgacaataaaattgaattgaataacaagataaacaataatttagagcagcaagcaatggctctattcaaatcgtggttcattgactatgaaccatttgacaggcaagtgccaactacttggaaaaatggcgttcttggcgattttgttgaaattaaacgtggtagttcacctcgtcctattcaaaatttcttgtctgacagtggattacattggttgaaaatatccgatgcaactggtattagctcaccgtttatcaatgaaatcaaagaatacatcattgaagaaggattgaaaaaaaccgtctttcttaaagcagaaaatttggttttatcaaatagtgccacacccggtttgccaaaaattcttgacatagatacttgcatacacgatgggtggctatattttccattatcagaattctcgaacgaatatttatatctgtatttcaaacacattcgagacaacttggttgcacttggcaacggcagtgtatttacaaatctgaaaacggatattctcaagaattatcacactttcttaccatcaaatgaggttcttaatgaatttgacgccattataaagcctatattttctatgattttatcaaacacaagagaatctaagcgattgacggaaatcagggatacccttttgcctaagttaatgtccggtgagcttgatgtctccgacatcgacctttaaaccactaaattattgtttatgttaggaggaataaaatgaaatataatttttattatgatgaatctgaacatagtagggtaatcactctctctaccataaaaggtgaaacatattatgataattttcttacagctattgtaggctggagctctgataacgagaaacacattaagaaaaaatataaattatttgaggaaaaatatgcacaaagaaaaaagaaagacgaactaaaaagtgaaacatttaaagcaaatcagtttatgtatggttttgcttcatttaatgggtctaatatagaattgatggatgatttcttttctatttttgatgatgacttttatatttatttatgcgtagcaagcaaaattgagtttattattcttcaactttttagggattaccataatagtttcattataaatatggatgcgataaaatgttcgattgttaagactatacttgtttatcgacctaaaaatgtaattgataatatatacaatacgccaaaggtatttgttgactctttgattgattttttacaaaacgattggagattaataaaaagaatttgaatttgaagaagagagaaaataaaatgtttgaagatattcttttaatattacatgaaatcgaacccccaattagtatcaattggaattatcatatatcattcataggatttgattattatttgaaaaataaaaaaatagatgattatactcttaccattgataaagaaggaaaagctatagaaagtagtaaaacacttgttgttgcaaaagaattaggactagaaaactgtaatgaattagattcaaaagagcattttggaataagaatagcagatatgttagtaggggtaattggtaaattaatgaaatcaataagtagtgctctacataaagaagaaaataaagtaaatgtgattaaaaatctattggataaagaatggttctatttaaatgataaacaattacaactttataaaaagttgtatcgtattatttttgaaattaataatgactggtataaaatatattcaggaaattattctgatgatcttatttgtttcttgggattattagaatatatgaatcattttaaatcagcagaagatataaaaaagattttgaaatgcatccagaatattgcaattcttgtatatgcagtcgtcttgaagagcattttaagcaaatgcataataaattaccgattgaacctttgaatacagaaaaccttgaatatttttacaatactcaaggtgcaaaagtttattatgatatggaaaaacagtctatattaaaattaaaagaaggagagaataaattttttgttttatcaataggaatttcaaatatgggatgcgctctaattactattaaaggagaagctaaaaatatatgttatagattgcctgttcaattaagtgattgggtgatgacaatagtagcaatgacaaatatgggtgaaaagctctttccatcagaagttgtatttacaaaaattaaagatcgttattttgctgatattttatagaaggggttgatgagaatgacatataatgaagctaactatgaaaattccgttattgaattatttaaaaatatggattatgaacatgtttatggtccaaatattgaaagagatttttatactccattttataaagatgaattagaaaatgcattatatgatatcaataaagaattatcttatactgcattgcaggaagcagtaaataagttaagaaatatcgaaaatggttctttagttcaaaagaatatggtgtttatggattatttgcaaaacggcataactgttaattactttgataatggtgaagaaaagtcagaaattgtttaccttgttgattataagaatgtaaataataattcgtttgttattgctaatcagtggacatttattgaaaatagtgaaaaaagaccggatgttgtattatttttaaatggtattcctgttgtattaatggaattaaagtctccttctcgggaagaaacagacatatcagatgcatataggcaattaagaaattatatgaaagaaattcctagtatgtttgtttataatgcaatatgtgtgatgagcgatcaattgagttcaagagctggaacaattacttcaggaatagatcgtttcatggaatggaaaactattgatggaaataaagagaatacacagcatgcacaatttgatactttctttgaaggaatgtttcaaaaagaaagattattggatattattaaaaactttgtatgtttttctaatgatggtgtagataaatttaaaattttagcaggatatcatcaatactttgcagtaaagaaagcaattgaatctacaaaaaatgctactgttacagatggaaaaggtggtgtgttttggcatacacaaggtagtggaaaatctttatctatggtattttatgcccatttattacaagagaagttaaatagcccaacaatagtggttattacagatagaaatgatttggatgatcaattatttggacaattttctaaatgtaaagattttttaagacaaacacctgttcaagctgaaaatagggaacatttaagatctttattagaaggtagaaaagcaaatggaattatctttacaacgatgcaaaagtttgaaaattatgacagtgcattatcacaaagaagaaatattgttgtaatggcagatgaagcccatcgaggtcaatatggattaactgaaaaaataaaaataacaaaaaataaagatggtgaagaaatagctacaaaagttataggtactgctagaatgatacgtaatagtttaccaaatgccacttatattggttttacaggaactcctatttctgcaaaagatagaagtacaagagaagtttttggaaattatattgatatttatgatatgactcaagcagtagaagatggtgcaacaagacctgtatactatgaaagtcgagttgttaaattaaagttggatcaggaaactttaaaattgattgataatgaatatgatataatggcgaataatgctgatgaggaagttattgaaagaagtaaaaaagaattaagtcgtatggatgctattttaggagctgatgatactgttaattctttggtagatgatattttgtatcattatgaaaataacagagaaaatttattgactggtaaagcaatggtagttgcatattcaagaacaattgccatgaaaatatataaacgtattttgcaacttcgaccaaattggacaaaaaaagttgcagttgttatgacttctggaaataacgatcctgaagaatggcgagatattataggaaataaaaaatataaaaatgaattagcaaaaaaatttaaagataatgatagtgaattaaaaattgctattgttgttgatatgtggcttactggatttgatgttccgtcattagcgactatgtacatatataaacctatggctgggcataatcttatgcaagctattgcccgtgttaatcgtgtttataaagataaagaaggtggacttgttgttgactatgttggtatagcaggtgctttaaaacgtgcaatgaatgattatacttctagagataaaaagaattatggtgatactgatattgctaaagtggcctatcctaaatttttagagaaattatctatatgtcaggatttattttatgaatatgattattctaaatttagagatggtactgatttagaaagagcaaaaacgattagtggagcagttaactttattgttgatatatcaagagaaaaagagaaacaggattttcttaaagaatcattattactacatcaagcattatcattatgttcttctctagttgaagaaaagttacgctttgaagttgctttctttgaatcagttcgtgttttagttttgagattgagtaatacaggtgtaggtaagaaaatttctttaaaagaaatgaatgaaagagttaatgaattattaaaacatagtattaaaagtgatggggttattaatttgttttctgatgtaaaagaagaattttctatatttgatcctaaattcttagaagaagtttcaaaaatgaaagagaaaaatttagcagtagaattgttaaagaaattaattgctgaacaagtcattgtttataaacgaactaatgtggttaagtctgaaaaattcagtgaacgaattcaaagagcattaaatagttacttgaatggaatgctgactaatgaagaagtcattcaagaattattaaatttagcaaaacagattacagaatcacaaaatgaaggaaacgaactaggtttaactagtgaagaattagctttttatgatgctttaacaaagccacaagctattaaagatttttatgaaaatgatgaattgatagcattgactaaagaactaactgaaacattacagaaaaataaaacaatagattggcaacgtaaagaatcatctagagctaaaatgcgtatgttaatcaaaaaactattaaaaaaacatagatatccacctgaaggaatgtctgatgcagttcaaacagttatgattcaatgtgagttatgggcagataatactgatatttgaaaataatcataaatgaaatattgagtacaagataataggaaactaatataataaaaagataagtttgtatagacgctcaagataagttgtgaagttatcctgcaggttgggtacgtactgacaattaaaatatattttcaaaacaattttattatttgattttgaaaagacaatgatttagaaggatgaatgggagaataaattataatggataatataaataataaattatataatattaataaaaatatctgtaaaaatttaaatttgatttctgaagaaaatagaagatttatttcacaaaatttattagcacaatttcgtacgttagttgagatattggctgtaaaatattatatgaagtttacaaaacaaaatctatcatacaattgggatgtaatacgcgaagcaagtaaatatttaaagaaaaatcctaaattgatttttttgaataaatttcataattgtttacaaatgacagaatctcattatattcaaaatgaagacggatcagaaagattaatgttagagtattttgaatatttattagaaataaagcagtttgttaaaactgaagataatattgatattttagataatctatataaatatccaatggatatagatccaaaacttcatgattattatttgaaaattaatcacctattttctttgcatgaaaattatgctccattttctaattcaaagggccaaagatgctatgttcaaaaattcacacctattttcataaataatgatttaatttatgaagttgtacttactcccgctgatgataaaataagtaaatttgacagagtgatagcttttacaaaatacaaattattgaccaattatgcaataaaagttgatattgttcaagataaaattaatgttattgatagtgaaatgcctatatctttaataatgggatgggaatgttcaattagaccttgtgaattgagtaatttttctagattgataggaataaaactgatttaaaaagtaatagtaatgaatataaaaatataatgaaaatattaacattaaatgaaattaatttattagatatggtacaattgaatcaatacttttttgaagaatatttgcgtgaaataagtttctcagtaagaaaagcagaatatattaatgtattaaataaatgcagaaatattattgataataatatttctggatcaaatgtaatacgttatttattatatattatgaataacagagttttgaaaaaacaatatggagaagaaaatgataatctatctaaaatgtatttagattatggatgtattccttttgataaaatgccttttgttacttcacttaaagcacataatcctagaatatatgatttaatgtattgttttgatttcaaaaatcatgagtttgaatttttagcacgtcatataaagataaatacagaaaatagaggagtattatatactgataagtcagaactaattaattttaaacaaattgatgattttagtttacagtacaataataaattgtattataaacacacacaccgaaagctattagaatataaagactatttatatattagtcaatatgaaaaagatgctataaatataataaataaaatccttgaattatcaaaatctggaattgaaggttataaagattctgttgaatggtggctaacaaatcaagaaaatcagatagatgatgataataaacaacaaattctaaaaaaattgtttatttcgtcatccgttgccatgatttatggagctgctggaactggtaaaacaacattgattaattatatatctaaattttttgctgatgagaaaaaattgtatttggcaaatactaatccagctgttgagaatttaagacagaaagttaatatatcaaattcggattttgcaacaatagccagtataaataaaaaattatcgtatgatattttaataattgatgagtgtagcacagttagtaatcaagatatggcaagagttttaaatagcattaattttgatttactaattctagtaggagatatttatcagattgagtcaatattttttgggaattggtttaaaatctctagatactttattccttcctcatctgtttttgaattagcaaaaccatttagaacaaaaaaagcagaacttttggatttttggcaatctgttagaaatataaaagatgatatgatttctaaaatggttgcatatgattttacaaaaaatattgataattcaatatttagtaaaacttctattgatgagattgtattatgtttaaattacgatggtttatatggtgtaaataacataaataaatttttacaaagtagtaatcttaataaagagtacatctttaaattaaatacatataaagtaggagatcctatattatttaatgattcaaatagattttctccattattacataataatttaaaaggtaagatctataatatcaatgataaagatgatgaaataatttttcaaattatactcaataaaagtattaatgaatttgatgttaaacactatgaaggccttaaatatataggtaatgatgcctcatcaagtaaatcaattattgaatttagtgtagcaaaagaagatgattctgatgaagatgtagaatcatatgatagtgttatgcctttccaggttgcatatgcagtttcaattcataaagcacaaggattagaatatgattcagtcaaaatagtgattactagtgattctgaagaaaagataacacataatattttttatactgcgattactaggtcaaaaaatgaattagctgtttattggactcctgaaacaatgaataaaattatgaattcttttgaaaagaaagatgggtttaaagatgcttgtattcttgcaaataaatttggtttaaaagcaaagaaaaaaagataataaggattaatttaaaatataaatattttcgttgttaattaatacataactattgaaaatctgatacatttttgatacactaaattcatcaaaagagtatatatttaataaaattgaacttaattttttatctaaaatcgtcataaaatggcgatttttttcttttgattgtattattttgtatgtgttatacaatttattattaaaaaaagtaagcggtaaataaaaaggtggattcctatatcacataccatgccttaaaattaagtctaagaatatttttcataattctaggaattcctggaattcttagaattcaaggtctttcttcctgaatttttctattattatcatgaagtgaaagagctgattgaatataatagttattatttgctttataagcaataaaatcaatttctaattgttttcttatgttttttactattttgattttcccttacttcttcaacacctatacctatattatattctcgttttttaagttcgttataaatgagtttttcttttatgtaaagctttatatttttcccgctggttataactttaatcatgtcattatcttctcgtaatgtaattgatataaataaaaatttctctaatatctataattaactccgaacttttggattgtttaccattttttcgtaataataaaatatataaactacatattcacaagtatattatgctagtatttaaaatattcatttatcaatgtttttaatttgaaatatataaaattgataaaagcagtttataaaactacgtcagtgttgttagatcgttcaaatattaggatagcgctggatttatctgcgcatccaaatatactgtaaaatattatgagcatagtagtgctatttttattataggatgaaatttaagaaattgcttgttaaataagtgatgaaatgagacaatataataaattattattataaatgaagctgtataagataaaagaaatgttaaatgatcatgttttgataggagggcacaactattatgaaaaaatattatgctgtaaaaaaaggaagaaaaactggcatatattattcatgggaagaatgtaagaaacaagtagataaatatcaaggagctcagtataaaagttttattttagaagaagatgcaaaaagataccttggtgaaaaaaataaaataaaagttgaacaacagcctaaattatctaaaccaataatacgatcaaaacaagatgatcgctcattaactgctgatcaaaaacaagcatatgatcatttactttcaggaaaaaatatttttttaactggtggggcagggactggtaaatcatttgtactcaatcattttattgaaacagtagaaaaacaaggaaaaaatgttttagtttgtgcgccaactggaattgctgcaatcaatattaaaggggtaactattcatcgctgtttccaggcatcaccagaaccacaagttattcataatattaaaaaagttcccgcagttgtaaaagagagcgatattatcattattgatgaaattagtatgtgtcgaatcgatttgtttgattttgtggtaagaacgataatgaaagctgaagagcagtctttaaaaagaaaacaaataattgtcgttggtgatttttttcaattaccaccagttacaacgcctaatgataaaaaggttttaaaagaattatatcctacctacaataaaggatatgcttttgaatcgacaaactggcaagatttggattttcatataatcgaattaaaagaagttattagacaaaatgatccagaatttattcgggaacttaacaagattcgtatcggtgatagttcagctattgcttatttcaaccatcatgctaaacatcaaaagatcgatgatggaattatcttaacagcaactaataaagtagctaataagatcaatcatgaagaattagataaaattccctctcgagctaaaatttataaatcaataataagtggtgatgttaaaagctatgataagcccactcaagatgagttgcgtttaaaagtaggagctagagtaatgatattgatcaatgatcctgaaggcagtttttatcaaaatggatcatttggtgtgattgaagaacttaatgaaagaagtgtaacagtttgcttagatgccaataatctaaaaattgaatttggttatcatgaatgggtcatcgaagattatgttctagctaaaagtattgacgatgaaatcgaagatcataaactaagtaaaaagaaaattggtttattttcacaaattcccttaagattagcttatgcgataacaatgcataagagtcaaggacaaacttatgaaaagatcaatttgattccctattcttttgattgcgggcagttgtatgtagcattaagtcgggtaaaatctttagaaggactttgtttaattaatcagatgagacaggaaaatttgatttgcagtttagaagttaaaaacttttatcaaattgagcagacggcaatacccaaggaacttatttatcagttaggaaaaaaggtcttagaaatggatgagaaaaatttaccaaatgaattaaaagaacttgttcaaaacataaaaaatcaagttttttaacaattgatcattaaatacatttataaaaaaggagtaagctgaatattcagtaggagtaaatatggactatcaacaatttataactttagtaaaagaaaaattatctaatatgaatgaaaaagataaagataactggatctatacatatgcaagaaaagtaaatagtgattatcggacaaattttttagaaagtttagatacatcatcaaaagaagtatcatatgatatagataaatatttaaaaatatttgaagaaataaaagatgaagaaatttatttacaggcctatgatgaagaatattatgatgaagtttatcatgactgggactatatatcacactatagcgatgtttttaaagttttacctaaaatcgaagaatgtattaggatatgttatgagtttattttagctaagcagtataaaaaagcattcctattgttatcggatttagaaaaaatggaaatattttatattaatgatgaaataggtgattgtgattatttatgtttagatgatttaaattatcatgatctaattgaaatagacatcaaagaattttatttggcttgtttgtattgtgcgatgaagcttgataaaagtcctgaaattatctttaattattattatagttatggtaaaacagatttacatattgatgatattttagcatatggacctgaggaaattgaaaatagtaaatcattgataaagaagacttgcgaatatttactttgtcgtcctggcaatcaagcaacgcagtttttaattgagggagcactttatttaggcaatcaggatgaattattgaattatgctcgaaaagcctatcaagaacatccatctttatataaaagatgctgtgaactagcattagaaaaagatgatcatgatttatgcattgaaattgctaaagaagcaattgaaaaaattcctgaatcccagtcaattcgtgctgacattattgatgtggccgttcaagcccaatgcgaagatccatatttttatgaaacagcatttttatcaaaacccacgactttaaattgtttacgtttatatagcgcaaataccaatatttcacaaatcaaaacccagtttttaaaaaactgctatcaaaatgtaaccgaaaaagagctaaaaatatatcgctttttattaggcgattacaaagaaatctatcaggaatgtctcaatgataaagaatctcttggctggagtatgagcctaaaaggaacgatcattccgttactattaatgttattaaaagaagatgagaagatatactatgctgatggacgggtcataagtgacttgcaaagccgattaatgatcaattcatctcaatatgatctttttgaaaaatattttaaagaatggaaaagaaaatttcaattagacgatagttttaaagaagcgtgtttacaatggcttttccatgaaattgatcaaagaacagaagcaatagttggtggtacgtatcgaaaaagttattataaatgtgctaatcaaatcattgttctaggggaaatattaaagaataacggtaaaataaattcagtaaatgaatttgttgataattatgttaagattcatgcaagaaaaagagcttttaaaaaagaagttttagagggaataaaaaaatattaagaaatatattattatattttttaatacgataattttaagagatttatgtcattttaaataaaaaaacattgaaatgataatatcaatttgatactattttttgtacagtagaaatacaataaaaacgatcatgtatcaatactgttaatagaaatatcaatgatatttcatgaatatgtaaacatatggtagtgtcaaataagttatgaaaaaatgaaattttttcataactagaattccatagtcgattctatgtaataattcaaggcttcatcaagcaatatgttccacttacttggcatattatgtgtcttttttaaacagtcaagctgtacaggcggtttatatcctagagctgtatggttccttaaaaagttaaagtatgttgtaaacagacacatgaagtcattggcacctgcaaacgtgttgaaaccgttcttgacggcatatgaatattgaaatgttcgatttaaacgttctatgatctgtttggcaggacgatgttcctttgatactggatcatcattcgtaagaccaataacctgtgtaactttaaagaaaacacgtttgagctgaaaatattgctgagctgccttatatataggattgccatctacaacgaattcgagattttcagggatttccttgaattttcttaaaacagaatagaaagcatcgatcgcactgaaagtatcacgtttcatgtatatcctattgttattcggtgaattattttaattaaaataacagctatttagtcaaacaaaaataataaacatagaaaaatagttaaaataatttgataaaatgataggcaaattattttaactattttattattatataaaggagctgacatacaaaaaaagaaagggtcattggatcgccctcctgcctttctttttctaaaataaaacgtatgttttacaatctatatgttatcatttcaaacaacttttatcaataaatatgatcaaaactcttataaagaagatattaaaaaaataaattattcccatatcagatgcacttgtggctctgttggacattttcacaaccatgcgacctacactcgttatttgcaggttgatgtaaatgatactgttcaattaactattacacgtatcaaatgtcaaagctgcaactgtactcatgcacttcttcccagcatcattgtcccttaccgcatcctgtctaatcctaatattatcaggattatcacttcttttcgcaataccaatgattctatttctgttatttccaaactcactggtttttcaatagaacttgtcagaaagcttatcatcttttatctaaaatatcacaaggaacgtctcgattcttttttgagtgtcttttcttcatgtgatctcctcagttttgatttcatcatcagctattttgcagagtatcataccatgtttatgcaacgtatcctgacgaaaaatatgatcatttattcatgattgctttttcccataacgtttcctttgaatacctgatataggtgttatatggttatgtcaggaggtatattctatatgaataatgtaaaaaaagaagatttaaatatgcagatcgctcttttcaggtatgaacagatcattcccgttctcaacgaaacctatcctgaccgttctgccttgcagtattataagagaatttcttctactccctttcagtatcctgatggaacatctaaagaattctcttttcaaaccattcgttactggtacgatctgtatcgcaagtatggttttgatggacttatgcctaaaatacgtggagataaaggaacttctcgcaagcttacaaagtgcatcaaagaaaaaataatcaaactaaaaaccgacaatccgagaatgacagcgacctctgtctatctgaagctaatagaggatggtgatattctgaaaaaggatgtttcactttcaacagtatcgagattcattgcttcaaggccagaactgaatcgccttcctgtcgaagatatgcgtgcctttgaaatggaacatgccaacgacatgtggcaattggatacgacctactgttcttatatcactaataaaaacggtcgtaagttaaggacctatctgatcatgatcattgacgatcgctcaagaatgatcgttggctatggattttttctggaagacaatgccgttaatgtacagactgttttaaaaagggctattggtaaatttggcataccgaaaaggatatttactgataatggttctccttataaaaatgaacaactgcctatcatctgtgctcagctgcaaatccaaataagccacgccaaagtttatcatggcaatcaaaaaggaaaagtggagcgagctttcaaatcggtaaaagaacagtggatgtacaatacagatttctcccaattcaaaacaattgatgatatcgataaagcttttggtatatatgtcaatcagaaaaacaattcaccacatgccgctttgaatgggcagacgcctgtaaatgtatttatgaatgattcccatatgataaagaggatcgatcgtcagcagctggaaaaaatattctatcatacagttactagaaaagtcatcaatgatgcaacgattagactcaatacaaagatctatgaaacaaaacaggaatatattggaacaagagtcacaattaaatatgtccctgatctaagtcatgttttcatatatgaaaatgacagctatatcgaaatatatgaggtcagaaaggttgataattcaagaataaaacgaaaaaggcctttatttgcacaggaggaacagctatgaaagatttcaagatatactatgggatggaattcaatccctttgaaaagggacagccagatatagaaatagatacagatgactttaaagaagcaataggaagactcaactatctcaaagatatcaggggcattggactttttactggaagaagtggtacagggaagacatttattatgaaaagttttagtgaatcgctgaatcctggactttataaagttgtttatatgcctatgtcaacacttacgacgattgaattctatcgtgaactgtgcagtcagttgggacttgaaccaatgcataaaaaaatagacaacttcagaaatatacaaaactatattaaaagtacagttgatgaaaaaaggatcatacctgtcatcatcctggatgaagcacaatatttaaagacagctattctcaatgatctgatcatgcttcttaactttaattttgattcaagtaattatgtcattttgatcatgacaggaactccagtgcttaatcatacaatcaaccgagctgtacacgaagcactgaaacagagaatcgttattcagtatgaaatgtcaggaatgaatgaagatgatataggcagatacatcattgaaaaactaaagaaagcaggaagaacacagccattgatattaccagaggcagttaaagcactgagcaatgcctgccagggatcatcacgcaaactcaataatcttctgactcattgtttaataataggagctgccagagaaaaaatgactattgataatgaaattgtaatggaggcagcaaatgagattggataaaaaaataacttatatatgtaattataagaacacttcatggcaatgtgtgttaaaagatataagtatcgatgatagaattactggatttacagtaagcgcaaggggaagcaggtatcgtgtatatgtaattaactttgatatgaagagatggctggatattccaggtattggagtatccagtgaacttagcagtttggatgatattttctggaacagtgaaaaaatagcctgttatatgaacagtattattgatggattgacgatagcaaaaggattaagtataataagcgctcatatagcacaataccaggcataacgttgaattttcatcagagaatacagtataaagtttaatattaaaagaggatagtaattagctgttaaaaggcaaaattactatctttttatattgaaattatagttggcgtaatttgacgggaataagtaaaatagtgtgattgtcataactaattagtcaaaataatggaaaaagccagttaaaataatttgataaattctagttaatataaagtgctaaataacaatcctatatgaagtgatgattttctttctgacatcacacatgaagaaaacataggcttttttgcctaaaactttcacataagtttcatcaccgcattgataaggattgaggtcatgcttaaagctatccatccagggaaaaagaagatgacttgcagcctgggcataattggcaattgtctgatgagatatcttgatatcatggacttcatggagaataagagcagtttttctcaatgaaaggccgtaattgacataataagtcagggcaagccctaaaacatgcttagaattgcgtatgcgtgtcaaatcgatctttgagggctcaattttaagctgaatgctttccagtctgtctaaagaagcattgaaaacacgagtgatgtaatgaagagagaaagcagaaggagtctgtttgtaattcttcctgtcctctttggaaagctttttcagttcagctctatagtgtgaacatttgggactcatgcatttataaatgtcaaaactgcttctggatttgataagagtcagttttttaccacagaaaggacattttctaacaacctgctgagaataggatttttcagtagagaaggtcttttcgcatactttacatttaatttgagatttcttttgaccattattaaaagaaaggtattcatgagtggcaccgcaatgagggcagacagtacctttatgtctaaaaaccggctttaaaggtttgttgtgtttagcttcataagcagccctggcttcatcgaaagagacaggaagatgttcaggttcgataacaggtaaaggatgaaccttgaatcttctgtaggcatcactaaccggattaggattaggatcgttaggaaggaactgaagaagaaagcattcaaatttatataaaagtttacgaaagatatttaataaagaaataataaatgatataatcttaaccatggtaattacactcctttgtgattgttgtggtgacttcattataggatgtagttaccatttttgtatagaggaaatggttaagtttatagattaatttcgggggaaattaatcagaatatataaaaaaccaaggtagaatgaggttttacagttaaaaagacatataaaaaactaactgttttttgacactaccaattaatcaagaggagataaaaaatgaaaaccagtgataaaagaaaaaaagaaatattagaaaaaatgcaaggtggattaattgtttcatgtcaagttcagcatgacgatccaatttatacagatgatatggtagttaaaatggctgaggctgcaagatgggcaggggcagtcggaatcagagctaactcgcctgaacatatcgaagctatcaaacaagcggttcccgaattaccaatgattggtttatggaaagtatggcacgatgatacagatgtttttattactccaacgatgaaagaagtaagagctatttgggaagcaggagcagaaattattgcattagattgtaccgctcaaattactcatgaaggaactcaggcatgggatttgatcaaagatgtaaaaaaagaaattcccgaagcaattatttttgctgatgtgtctaattatgatgaagcaaaacgagcgatagaaaacggtgctgatatagttgcaccaaccctatatggttatactaaagaaacttcacatatcgaagagccaaacatgcgtgaatttgcaaggatgtgcagagattttaaagatgatgcttatgttatgatggaagggcatatttataccccagaagatgcgatgaaatgtattttcttaggagcacatagtgttgttgtcggaagtgctattactagaccgcatttaacggcaaaaagatttgttgacttattaacggggtatcaaaataactggcgtgatgctgaaaaagcaaaacattaattaaattatttttacaaaatgtaatagctaatttggctgttacatttttattatggtaaaaatgattttatagaaatattacatagcatcataataatttaaagtagttattaaatgctataaaatataataatattaataaattaagtttgtttaatcattaaaaatatagtaaaattgtaataacaataggaggtaaataagatggatgatttatttcaaagtaatatcattgataaaaattcagcaattcctttatattatcaattatatacttatattgaaaaattaattaaagaaaacaaactggtagaaggcgatcgtttacctccagaagatgaactcgtaaaaattcttaaaataagtagaccaacgattcgtcaggcatataaagagttatcaactaaaggttatatccaaagaaaaagatcaaaaggaacagtagtaaccaagcctaaagttctaagtaaatttttatcagaattaacaaattattataatgagttaagtgctgaagacatggaagttaagactaaagttttacagtttgaaatcactaaagatcaaaaagcccgtgaaatattaaacgctaataaactgattcatttaacaagattacgttatagcgataatgtgccgctagtttatattgatacttatttaccatatgatagttatcaaagtttattttcatatgatttagaaaaagaatctttgtatgaatcaatgaaaaaaataggacgacctgtagaaagtgtaaaaagaataattaaagccagccagtgcagtaaagaagttgctgattatttagaaatagagacaaaagaaccaattttatatagtcaaacaattggaaaagataaaaatgaagaaccagttgagtattcaattgcaagatataatggggcgattgcacagtttcaaattgagctaagattgaatgattagaatctatcttgaagatagattttttttaaattattgactttattaaaaactaatgttatattgtaattacaatataacaaaggagcaaaaaaatgaaaaaaatcattataactggtggaaaaggtttttttggttcccgctttttaaaaatgtgggagaaaaagtatcaggttttaacgcctggttctaaagaattagacgtaacagatgaaaagatagtcaacgcgtatttattaaaggaaagacctgattatgttattcatgccgctgcgattcctgatcagcagtactgtatagaacatcctcaaagagctcgagcggttaatgttgatggggcaataaatgtagctaaagcatgtaaaaaaatcaatgcaaaattagtttttatttctactgaacaagtttttaatggctcaaaagaagctggaccatacagtgaagaaagtgaaccatgtccaaatactgtttatggagaaaataagttagaagtagaaaatagattgcctgatattctccaagaatattggattgtccgttttacatggctatttggcttaccggaaagagattgtgctttaggaagtaatattttatgggatacgatccaaagtttacttgctggtaaaacgataacaactactcattatgaatatcgaggaatgagtgatgttaaagaaatatgtattaatttagaaaaattattttctgcaccttatggaatatatcattttggatcgatcaatgatttaggtcgttatgatgtagtaaaatatattatggagttattaggtgtcgaccagcagatcattgaagatagattaattagtgatgatagtcactataccaaagatgatccccgtgatttacgcttagatacgactaaagcaactcaggctggcttaatttttatgccgactaaagaagcaattaaaaattgtttattggaatttggaatcattaaataaaaatatcgaaaggaatataacttagaacagtttctaagttaactaagtaaaaatggaaacagaaactttaacaagagaacaattagctagaatgtttgatcatacttttttaaaagcttatgcaacaaaagaagattttattaagttatgtaaagaagcaaaagaaatcaatgctgccatggtagccatcaacagtgcgccagtaagcttttgtaaagaacagttaaaagattcatcagttcatgttggagctgcaatttcatttcctttaggacaaacgcctttagaaataaagttggctgaaaccaaaaaagcaatcgtagatggtgctgatgaaattgattatgtagtaaatatcggaaaagtaaaaatgaaagattgggattacatccaagaagaaatggaaagtatcgtaactctttgtaaagaacatcatgtcttatcaaaagtaatttttgaaaattgttatttagaaaaagaagaaataaagaaattagctgaaattgcaaaaatagtaaaaccagattttataaaaactagtactggttttggtacttgtggggctttagttgaggatgtcaaattaatgaaagaagtagttggtgatgaagttcaagttaaagcagctgggggcattagagattgggcaacttgtaaaaagatgatcgaagccggggctactagaattggaacaagtgcatcatttgcaattttgaaaggatttgatgaagaacatgtatccgtttaaattcgaacccatttatgtagaaactgtatggggagatacgaaatttgctaagattcgcggtagaaatgaaataatcggctcaagctgggaaatcagtgctcatcctcatgctgataactgtattgccaatggtaaatataaaggacagacactatcaactttattagacttatatcctaaacaaattttaggaaaaaagaaaagaaatcagatgctgagaatttcttttttagacgctcgagactctttgtcaattcaagtacatccaaatgatgactatgctcataaatatgaaaacgatgaaggaaaagtagaagcctggtatattttaaaagcagatcctaaaagtaatttaattgcaggaacaactactgatgatattcaagttatcaaacaagcaatcaaagatgaaaagattgaagattatgttgatagaattgagataaatgaaggcgattttatttgtattgaatcaggacagctgcatgcttttggaagtggattgttaggattagaaattagtcaaaatagtgatgtaacatatcgcttttacgactttcatcgcaaagatgccagtggtaatgaaagagaacttcatttagataaatgttttgatgtggttgatttttcaaaaaaagggcaaaaatttgcttatccatttaaaatgcaacaggaaacaacagtatatcaaaggaaagaatttacaataaagttgattgatataaatgataaatatacactttatcctaatggagatactttttactgtttaacgaatgttttaaacgattgtcatataatttatgaagatcaaattatagattttggttttacagaaaacattttgattcctgccgattgttctaaaataacttttgaagggaaaacaagaatcattatcagctatgttgattaaaatttcacaaacttgttaatttcataatatctagctataatatatgcaggaggtatttaggtattatgaaaataaaaaaattagttttaatgactatgatcatattaggtattacaggatgcggtaatagtacagaaaaaaataatgatttttggtcagcgactattaatgttttagaagataagttagaaaataatagttatgatgaaggaaattggcaaattggcgttcaagataagtcacaggttgaagacgaagaacatcgatctttaacgattcgtgagatttttgaagagaaaaacgtaactaaaacaacgatgttttctttacaaaatcaaaatgatacaaaaacaatttcatatatttacaaaaaaagtgaaacagacaataataatcattatgaccaaacagtgacaattgagtcaactgatgaatcatatcatgaatataaaatcatttatagttatgaagagtatcaaaatgaaaattatcatgatggtaaagaagcaaacgggacatttaagatcggaaatgataataaaataacctatgataatgttcctttgttgaaagaagcactaaatgcatatcttactttgatcaatgattttcaacaagaatttaatctcaattatgatgaatatgattttgttaatttaccagcattagcaaaagatcttgatgttcccgacttagataacattgatgaagaaacatcaacaacaactgattattattcagaagcatatataaatgctagaggcttttctttaataacatttttaaaattaaacaaagatttttcatcagctgaatttggtatttataatgttgaaaaaaaagagtatgagtcaaatgcaacagttacatttgaaaagcggggaatcgcagactgttataatattatccaaaaaaatgaccctgatgttaattatgctgtatattttagtggtgatacagcttatgtatatctgcaatcattaactgatcaagaaattattgatgatgttcaaaatcaaggtacaaatgcaactgatattttaaaaatcacaaataaaagttattcagattattaataaacaagcatcataggtgcttgttttgttgtataagtatagatataatttagatatgagatctaattattgattattaaaaccaggtggtaaaaatgatggcgttacttttaataatattattgataattattatctatttaattatcaaattaattatcaaaatcagcaaaataagatttaaagacatagagataaagtcagagcgcaggattgctggtgacttaggagaaaagaaagctgctttaattattgaaaggataatagatgaagatgataaattattgaggaatgtaactattagatatgaggataaagaaactgaacttgataacgttattgttagtaaaagaggcgtatttattatcgaagtgaaaaattataaaggtgagctagaaggtgatgaggatagttatgagtgggataaatataattatagtaaaaatggtaatatttatttaaaaaaagttaaaaatccgataaagcaaataaagagacaaatttatattttaaagagttttttaaaatactatggtattgatatatgggttgatggttatgtgtatttattaaattttaatagtcccgtttctaatgactacattttagaaaatatcgatgaaatggatcgagttttgcataaaaaagtagacagatatttgaaaaaggatacagtaaatagaatcatcgaattattacaaaattgacttacttttatttatccagataagttatatttgtgataatttgaagatcaaaaattgtatgaggttaattatttaaaaacttataagtattaattaaatttattagttataaaatcaagggaaatgtttatgaatgaaaaagaaaagatggaaaaaggattatggtatgatgctaacaatgatgcatatttaattgaacaaaggcttaaagctaaggatatatgttttgatcttaatcaaacaagacctggagaaaaagataaaagagcggctttgatgattaaattattaggctatcagcctaataatttagaactgctcagtccttttatgtgtgattatggaaataatattaaattaggtaaaaatgtttttattaatagtaattgctattttatggattgtggtgagatcataattggtgataatgtttttatcggtccttcatgtggcttatatacagcaaatcatcctttagattttcaaacaagaaatcaagggttagagcaggctcttacaattactattggtaataatgtttggcttggtggtaatgttgtaattttaccgggaattacaattggcgataattgtgtaattggtgcgggaagtgtcgtaactaaagatattgatgctaatagtattgcttgtggtaatccatgcaaagtaatgaaaaaagtaaatcaataaataatgccgtagattattaagtaatcttgcttaaatagacatagttatgttacaattagtaaatctcataaagaaaggaaaaagatgatgagtaaaataaataaattaggacaatacaaaaatgtcgaagtaacggtaaataaacaaactgttactcaagaagaaattgatgatcaaataaaagcattagtagcgcaaaattcaattcttgaagaaaaagatggtgaagttagtaatggcgatgttacaacgatcgattttgaaggatttaaagatggtgttgcttttgaaggtggtagtgctaaaggtcatcagttagaaattggttctggtcaattcattcctggctttgaagagcaaatgatcgggatgaaaaaaggtgaaacaagagatttaaatcttactttccctaaaaactatggcgctcaggacttagcaggagctgatgttgtatttaaagtaacagttcataaaattgaaactaaaaaagaagctgaattaaatgatgaatttgttgcttctttaaatgttccagaattaaaaacagttgctgatttatatgaaagtatgaaggttaatcttcaagcacaatatgatcaagcatatcaatcacaaaaagaaaatgccatttttgataaagttttagctgatagtgatgttgagatagctgatgatgaattaaaaattgctttagaaaaacagcttcaacatattacaatgcaattagctcaacaagggatgcagttagaacaatatttacaaatgatgaatatggatgaaactgcatttcgtcaacaagttgaaccatcagctaagcaacaagctatttttgaagccatcattgatgaaattataaaaatcgaaaatattgatacaactgctgaagaattagaagaacaaattgaaaaactggcttcatataatcaaatgtctaaagaagaagtattaaaacatgttgaacgtgaaaatttaaaacatgattttaatcgtgttaaagcaagtcgtttgattattgaaagtgctattgttagtgaataaccggtaggatctcctgctggttttttctgcttaatatgatttatggatcaaagaaaatagaaattttaaaattaacgttaatgttatataataaaaatatattatttaataagacatattatattagaagaattatcagattagttgcaaatgtggcttacttttaattaaaatattaaataaagaagaggtaaaaacaatgttagctagattacatgtgattattgcaagtgaagcagataaagatattgagatgatcaaacaattattattaaatattgatcctaaattttctatttcaccagcccgacaatatcaaggattaaaagatcatagtgaattttattgtacttgtgatttattagaagatgaggtacggccattattagataaattaaataatgactgggatggagaatattttgattgtatttgttatgggtttaatacgaaaatgtttcatgagttaatttatcatttaggatttgttttatttgattagttatgaatatttattaattggatcattaatgtaatagagagatttaattaaaagattataaaatttaaagttatatctgttttttattattcaatatgaaacttttgattattttagatattaaagtatgtaagagatatattattaattacatacatttttttattaataaaatataaaaaattatttaaaataactagtttttttactatttaccttgtatgatatttattaggaggcaaaaaaagaaaaggaggtattttatatggagacatacggtattgaaaagtatggtattgtcacaacaagatctatttttagaaatattcccccaggatcattagtagaaaaagctttgttaaaaggggaaggccgtttaagtcgtgctggggcattatgcattcatactggtaagcgtacgggaagatcgccagatgataaatatattgtcgatactccagctgttcatgatttgattgcatggggaaaagtgaataaaccagtatcacgtgaaaaatttgatttagtatatcaacaaatgattgaacattttaaagataaagatatttatatatttgatggctatgccggagctaatcctaaatattcatatgcttttagaattatcaatgaaaaagcaagtcaaaatttatttatttcaaatttattgattaaaccaacgcctcgtgaacttcaacactttcaagaagattatttgattttagcagcaccagaatgtaaagttgatccgcaaatagggttaaatagtgaagttgctgttatgatcgactatgaacgacatattgtcttaattgcgggaacaggatattccggtgaaattaaaaaaagtatattttgtgtcatgaattttgtactaccacaaaaaaatgtttttacgatgcattgttctgctaatattggacgtgatgggaacacagctctattttttggtttatcgggaacaggaaagacaactttatctgctgatccaggacgtaaattaattggtgatgatgagcatggctggtcgcaaacaagtatttttaattttgaaggtggctgctatgcaaaatgtattaatctatctaaagaaaatgagccggaaatttgggatgcagttagatttggggcagttgctgaaaatgttcagttatttgaagacacccgcattattgatttcaatgatgattcgattacagaaaatacaagagtagggtatccgctacattttattgcaaacattgaaccaagtggggtcggcaaaccgccaaaaacaattttctttttggcagctgatgctttcggtgttttaccaccaatttctaaactagatccaaattcagcaacatatcactttgtatcaggatatacaagtaaattagcagggacagaagatggcgtcacagaaccacaagcgacattttcaacttgttttggagaaccatttttgccattagatcccttactatatgcaaaacaatttcaaaaacacgtagaaaaatctggagcaagtgtatttttagtaaatacaggctgggtaggcggctcttacgggattggaaaacgaattccattaaaatatacaagagcaatgatcaatgctgcaatgaatggtgatctagactatgtggcttatgaaacagatccattctttaatctaaatattccaaagttttgtccaggggttccacaagaattattggatccaagttcaacctggctgcataaaagtgaatatgataaaacagctcgtaaactagtagaaatgtttgttgaaaactttaagaattatgatcatttcccacaagcaattattgatgcgggcccaggggttccaagttataaagttaagaaaaataaattataattgaaaatataatattttatagtagattctaagtaaggaagatgaaaattgatttatcaataaattcttcctttatttattttctaaatactataaacataaaaaatatgatatataacagcaaatacaagaatgaatgacaaaaaaagatgaattttattccaaatcatagaatctctattaataagatatgctgacaaaattaaaacgagcataattaaccacgcaatcattccgctagccattccagcattatgtccggctaagattccatgaagcaaagaaaaaaaggctaataatattgcatatgttttatgataacttaataatttaggaaaaatcccttccttttttaaaggaaccagcatacatagaagcaatagaactatacataatattaaaataagatgcttaaagaaaaacataattacagaacctccagtttatttttagaaattatcactgtcgaattataacgattaaagaggcaaagtcaatcaataaaagggatacagttttatatataggatatattattaaaaataagtgataaatatgaaagcaattatttttagattagaaaaagaattactaatttgcttttattgtagacataatattaatgtgatataattttgcatattcatttaatagttagatgatgaaaggatcaatgatgagtgagaaagaaaaaatgattaatggaaaaatttatgatccattaaatccaagattagttttagagcgtgataaagcgagcagactttgtcaacgatataatcaaaaaaagtttcatgaaattagaatgcaaaataggttaatgaaaaaattaattaatactagcggtaatttttggatcaagccgccatttttctgcgattatggttataacatatatataggtgaaaatgttatgttgaattatggctgcatcttacttgatgtctgtccaatcagaattggcgcttatacattaattggacctaatgttcaaatatatacagcctgccacagccttgatcccgaagaaagaatgaaaaatattgaatatggcaaagctgtaacgatcggtaataatgtctggattggcggtggtgcgattattttacctggtgtaactattggtgataatgctgtgatcggtgccggagcagtagtaagtaaggatattccagctaatgtggttgccactggtaatccttgtcgaattttgcgaaatattgatgataatgatcgattagtaaaaaataaataaggtgctgaataatggaagataaattatcaaatttaatagctagatataatgctgataaagaattaaataatctaaaagatattttagattatttacaaagtaaatctgtttatatttatacgacaatcaaaatttctaaaaaaaaattaaagcaaatacccaaagatgacttattaatgattttaaataatatatcaatcataaataatcgacaatatttttctgtttattctaataacagttttacctctaatcaatcatattgtttagaagtaaatatgatcgactgcctacaatttatgaaaaagatggctaagactgatgaaataatcattgatccaaatacagaaaatagtttgattttagacaaaaacacaataaaatatcttaaatattatcgataataaaaaaggaacagtatggaaaagttaaattataaaatagatcttatagctaattaccaaaatacagttaaatggaaattaagaaattttttaaaatcaatgatcataggtgttaagatatgtttttaaaagaattagaaaagtttgtttcagaagatgaatttgaagctaaagagcttcaaattatcaaaaaattcattaaggaaaatcccgacaacttgactcgaaacaatgaaatagcacacataactgtatcagcatggatcacgaattcttctttagataaagttttaatgatatatcataatatttatgattcttggagttggccaggaggtcatctcgatgataatgaaaatttagttcaagcagccaggcgtgaagttagagaagaaacgggaattgaaaatttgaagcttttaactgatatttgtatttcagtagaaatactgccagttcaagcacattataaaaatgataagatcgttccggcgcatcttcatctcaatatttcatatgcttttatggctgatgaaaagcagagtattagacctaaacttgatgaaaataaagccgtaaaatggcttatgatcaatgaaatagataagctggtaactgaaaaaaatatgctgtttatctatcataaaattatcaagcggatatcaaatttagataaatataagaggtaaatttatttatattgacaaacttcttagattaagatattgttaaagagaaaaaggatagaggttgcaaagcgtcagagtactatagtgagtaggcatacgatgatctataggaaaggtaatctttgccgatagataataagtggcaatttattatctaggggctgtagggaatacttacagcactccttcagttatgaagggcgctattaacgcaaaataaaagtcgtgttaatagcacgacttttttaatatcaagtgaggagaagggaaatgaaaaaactattaaaaatctttacagcattcatattagtattttcaataccagtaccagtaaatactgtaaaggccgaagaagatgatgacaatacatttgttgtcgggatggaatgtaattatgcaccgtttaactggactcaggtcaatgagacggatacgacagtgcccttagaaggcagtggttatgccgatggttatgatgtaactatcgcccgagctattgctaaacatttaggaaaagagctagtaattaaaaaaatgagctgggatggtttggaaccagcattacaagctggagtcattgatgctattattgcggggatgactgatactgctgatcgtcgccaaagggttgattttacacaaacatattatgaatcacaaatggttttaattgtaagaaaaggtgatcagttagaagatgctaaaagtctaaaagacttttctaataaaaaagtattaggacaattaaatactttatatgatactgttattgatcaaataccaaatgttaaacatgctacagcattagaagattatccagcgatggtaatgcagttaaataatgaattagttgatgctgtgacagctgaattacctgtagctgcgggaatcattgcaacaaatcccgatttaacgtatgttgaatttgacgaaggaaaaggatttgatgttgatttaacagatacttcagtatcgattgctgtaaataaagataatccagaattgaaagatgcaatcaatgaatatcttgatactttgtctgatgaagacaaaaaagaaatgatggatgaagcaattgaaagaattccagctactattacaagtttaagtagtaatatttttgttgctgctaagcagatttttgaagtatatagtccgttattttttagtgggatcggttctactttaactttggcttttgggggaacgatcttaggattattgattggtttgataattggtgcgattcgagcaatcaaagttgaagaaagagatagtctagtaagtaaaactattaaaagaattgcatggataattacgactttatacattgaaatatttagaggtacaccaatgatggttcaaggagcatttatctattatggccttaaaaatatcgttcattgggatccttttacagcaggtatctttgttattacgatcaataccggagcttacatggctgaaatcgttcgttccggaatacaatcagttgataaaggacaaagcgaagcggctagaagtattggaatgaataacattcaaacaatgatttatattattttaccacaggccattaaaaattctttcccatctatcggtaatgaatttgtaatcaatattaaagatagtagtgtgttaaatgttattgctgttactgagttattctatcaggcaaagagtgttgctggtagtttatatgcgtttgttccaacatactttgttgttgcattgatctatctatgtttaacattcccaacaacaagaatcttgaattatattgaaaatagaatgaatcgaaaaaaagctatttcttttgatgcagaagggagtgtaaaataatggaaccgattattgaagtaaaacacttaaagaaatcttttggtgatctagaagttctacatgatattgattttactgtttctaaaggtgaagtagtaacgatcattggagctagtgggagtgggaaatcaacttttctacgctgtttaaatattttagaaacgcctaatggcggtagtgtgatgtatcatggtaaagatattttaaaaggtgagatcaatgttaatgttcatcgcagtaaagttggaatggtatttcaaagttttaatcttttcaataataaatctgttcttgaaaactgtgtgatcggacaaatgaaagttttaaagcgaaatcgtgaagaggctacaaaaatagcaatgagatatttgaaaaaagtaggaatggaacgttttgcaaaagctggcagcatgcagctttcaggaggacaaaaacagcgtgtagcgattgctagagcattatgcatggaacctgaagttttattatttgatgaaccaacaagtgccttagaccctgaaatggtcaatgaagttttaaaagtaatgaaagatttagcgaatgatggtttaacgatgatcgtggttactcatgaaatgcagtttgcaagagatgtctcttcaagagttgtttttatggatgacggagttattgttgaagaaggatcgccagatcatatttttaatcatccaactcaagctagaacaaaagagtttttaaagagatatttaaatcaataaaacaagtgcctaagttagcttaggtacttgtttattgatgtgttatatggctggtgttatgatattatttagtaatcaggtagtgtcaaataagttatgaaaaaatgaaattttttcataactagaattccatagtcgattctatgtaataattcaaggcttcatcaagcaatatgttccacttacttggcatattatgtgtcttttttaaacagtcaagctgtacaggcggtttatatcctagagctgtatggttccttaaaaagttaaagtatgttgtaaacagacacatgaagtcattggcacctgcaaacgtgttgaaaccgttcttgacggcatatgaatattgaaatgttcgatttaaacgttctatgatctgtttggcaggacgatgttcctttgatactggatcatcattcgtaagaccaataacctgtgtaactttaaagaaaacacgtttgagctgaaaatattgctgagctgccttatatataggattgccatctacaacgaattcgagattttcagggatttccttgaattttcttaaaacagaatagaaagcatcgatcgcactgaaagtatcacgtttcatgtatatcctatatgaagtgatgattttctttctgacatcacacatgaagaaaacataggcttttttgcctaaaactttcacataagtttcatcaccgcattgataaggattgaggtcatgcttaaagctatccatccagggaaaaagaagatgacttgcagcctgggcataattggcaattgtctgatgagatatcttgatatcatggacttcatggagaataagagcagtttttctcaatgaaaggccgtaattgacataataagtcagggcaagccctaaaacatgcttagaattgcgtatgcgtgtcaaatcgatctttgagggctcaattttaagctgaatgctttccagtctgtctaaagaagcattgaaaacacgagtgatgtaatgaagagagaaagcagaaggagtctgtttgtaattcttcctgtcctctttggaaagctttttcagttcagctctatagtgtgaacatttgggactcatgcatttataaatgtcaaaactgcttctggatttgataagagtcagttttttaccacagaaaggacattttctaacaacctgctgagaataggatttttcagtagagaaggtcttttcgcatactttacatttaatttgagatttcttttgaccattattaaaagaaaggtattcatgagtggcaccgcaatgagggcagacagtacctttagcaggataatctttacctttatgtctaaaaaccggctttaaaggtttgttgtgtttagcttcataagcagccctggcttcatcgaaagagacaggaagatgttcaggttcgataacaggtaaaggatgaaccttgaatcttctgtaggcatcactaaccggattaggattaggatcgttaggaaggaactgaagaagaaagcattcaaatttatataaaagtttacgaaagatatttaataaagaaataataaatgatataatcttaaccatggtaattacactcctttgtgattgttgtggtgacttcattataggatgtagttaccatttttgtatagaggaaatggttaagtttatagattaatttcgggggaaattaatcagaatatataaaaaaccaaggtagaatgaggttttacagttaaaaagacatataaaaaactaactgttttttgacactaccagtaatcatcagggggaattattatggataaaaaagttgatctagtaacagggacgatctggaaacagttattattatttttctttccaattttgattggaacattttttcagcagctttataatactgtagatacgatcattgtcggtaaatatgtaggtactccagctctagcggcagtaggatccaccggcaatttaactaatttgatcgttaatttttttgtgggcttatcatcaggggcaactgttgtaatcgctcagttttatggggcaaatgaacataaaaaagtttttaaagctgtgcatagtgcttttgcaatgtcaattatttgtggtattttgatgatgatttttggtatctttttttctaaacagtgtttagagctgattggggttcctaacgatattatcaacgattctagtttatacatgaaactttatttttttagtatgttaccaggggttatttataatattggttcaggaatcttaagggctgttggagattcaaaaacaccgctatattatttaattgtttgcagtgttataaatgttttatttgatttatttcttgttgcaaatatgaaaatggggattgcaggagctgcgattgctacggtaattgctcaatttgtatgtgcaatcttagtaaccgttaaattaatgcgcagtaaagaaagctatcaattaaaattaaaagaaatcaaaatagatttaatgattttaaaaagaatcgttaaaattggcataccagctggaattcagtcaacaatgtattcaatttcaaatattgtacttcaaaccagtattaacacttttggaactaatacgattgcttcatgggccgtatatgtcaaaatcgatgctttattttggatgatcatgggagcatttggggcttctattacaacatttgtaggccaaaattatggtgctggagcaactgatcgggtgcgaaatggaatgaaaagttgtttaataatggcgctgggatcagctgttttattaagctgtttttttaaattttttggtaataatataatagttttattttctaatgatgccaatattgtaaaagaatgcagcagtatcatgcattttttatcaccgttttattttacttattgttgtgttgaaataatatctggaacaatgcggggctgcggtgaatcatttaaaccaatgatcgtagtctgtttaggcatttgtgtccttagaattatctgggtcatctttatttcgccaatttatccaacttttaagatggttattgtttcatatccgattacctggtcaataacttcaattttgtttatctttttttaccaaatatttcaaaaaaagaatttataaaataattttcaaggatattgtaatttctataagaatatttataataatattattacattaaaagtgggatgatagaaatgaaaaaaatagtattaggcatattagcccatgttgatgctggtaaaacaacattaactgaaagtatgctgtatttaagcaaaacgatccgtcagttaggtagagttgatcatggcgatgcctttttagattataatcttcaagaaagaaatcggggcattaccattttttcaaaacaggctatttttaattggaatgattgtcaaataactttgatcgatacgccaggtcatgttgatttttcaactgaaatggaaagaacattacaagtattagattatgctattttagtaattagcggaattgatggaattcaaggtcatagtgaaacgatttggagattattagcgcattatcagattccaacgtttatttttgttaataaaatggataatatgaatgctaataaagatggtttattgaaggaattaaagagtcatttaagtgaaaattgttatgattttgaagatcttgacgaaagtttttatgaaaatattgctttaaataatgaagcgttattaaattattatctagatcataatacccttacaaaagatatgctgattgatgaaattaataaaagacaactatttccatgtttctttggttcagctttaaagatgaatggcattgatacttttttaaacggatttagtgattatacaagagaaaaaaattattcagatgattttggagctcgtgtatttaagataagtcatgatgaacagggaaataaattaacgcatctaaaaattacaggtggcgctttaaaagtaaaaagtttgatcaatgaagatgaaaaagtagatcagattagaatatactctggtaataaatatcaattagttaatgaagttaaagcaggagcagtttgtgcaatcaaaggttttaaaaatattactgctggacaaggactaggttttgaagataatgtgattcagcccgtattatcaccatatctggattatcgtattattttgcccgataattgtgatcaccacaaaacattaaaagatttaatgcagttagcgcaggaagatccccaattacatatcaattataatcatcaaactaaagaaatacatgttcaattaatgggggcaattcaaattgaagtacttaagaatttaatcaacgaaagatttaacatcaatgttgattttgatcatggaaatattatttataaagaaacgattttggaaactgtagaaggtgttggtcattttgaaccacttcgtcattatgcagaagttcatttacttttagaaccaggtaagcctggcagcggtttacaattttttacttcttgtaaagaagatgttttatcaagtaattatcagcgtttagttttaacacatttaaaagaaaaagaacatttaggggtattaacgggatcttcaattacagatatgaaaattactcttttagccggtcgcgctcatttgaaacatactgaaggcggagattttcgtgaagctacttatcgtgctgttcgccaaggcttaaaaagtactaaatcgattcttttagaaccctattttaaattctctttacaattacctggagaatatttaagtaaagcaatttatgatcttgaagcgatgaaaggaacatttacattacctgaagatcatgatgaaatcgttactattactggtagggcacctgtaagtaaaatgcaggattatcaaaatgaagtcattaattataccaaaggaaaaggtcgtttaatttgtcaaatggatggctatcagccatgccttgatgaacaagacataattaagcagtttaattatgatagtgaggctgatattgaaaatcctaccggatcagttttttgcagtcatggttcaggatataatgtcaaatgggatgaagtaaaggatcatatgcatattccttttcagtatcaaaaaacatcaaactcaaaagtagaagtttacgaaaatagaaagtttaatagtgaggatgaggaacttgaaaatatctttattcgtacttatggaccagttaaaacaagaacgaatagtaaaaagtctttaatgaaatcagaaaacacttctacttataaacagattccagaatgtttgcttgttgatggttataatattattcattcatggccagagttaaaagaattggctaaagacagtctagatgctgctagaacccgcctagtcgatattatgtgtaattatcagggatacagaaaatgtattttaattctagtttttgatgcttataaagtgaaagataatctggggactacttataaatatcataatatttatattgcttatactaaagaagcccagacggctgatatgtatattgaacgagcaactcatgaacttgcaagtaaatataatattactgtagcaacatcagatgctttagaacagctgattgttttagggcagggggctaaacgaatttcggcgcgggaattacgtttggaagttgaacatttaaataaagaaaaaatggctgagtttaaaagacgtcagccaaaaggatataattatttgttacaggaaattaaagattataatgaggagtaaaaaacttatgacatttcaatacaatcttaattatattggtggaattagcggttataataagcgcgcaatttatactttaaaaataaaagatgattgcttttttgtaaatggtttgattaaaagtaaaaaattttcgtatgatcaaataaacaaaattatttttggaactactgatgaattaaaaggcaggattatcgaagtaaatgatctgctttttaatcatgtaaaactgcttgattatcgcttaaatcgaaaattacgttattgtttagtaatcgtcttaaaagatacaacgattatatttgctgaagaagatgatgcaaatattaaaaatgcttatcaaagattaaataaagtttatctttcaacaaaaaaataatatcttaaaacggtatgaatacataccgttttaaattatacattttttaaattaacaattgcatctttaatgcgcttgattgtttcatctttacctaagatgtgagcaatctcaactgctccccctggagtaaatgctttaaaagttaaagcaactctgatcggatacatgatttgtccatttttctttccattttctttagctagttcaataaacttattttttatcttctcttcatcatcaaaatctaaatcacttaaatttgacaagacgatttctaaagcctctaaagaattttcaatcgttgttttcatttttttattgataaacagctcggctttaaacggatggggactatcaataaaatcaacagcttccggaatttcatttaatacttgaatacggggctgtaaaattttagagagttctaaatagttgatcttggttttgatattgtcttgataataactcaaagcatgatcattaaattgttcaattgacatctttcgtaaatagaccccattcatccatttcaatttttcaaaatcaaagatagccggtgatttactaatgcgatcaacagaaaaaatgttaaccagctgttcaagtgaaaatatttcctcttcaccttctggagcccagcctaataaagcaatgtagttgataattgcttcacttaaaaagccttgtttaatcaaatcttgataactagcatcaccattacgtttactcaatttattttgagcatctttcatcactgggggcacatgaatataagttggaatctgccaattaaaagcttgatagatcaaattatattttggagtactagataagtattcattgccccttataacatgagtaatattcattaaatgatcatcaattacattagcaaaattgtatgtaggatagccgtcacttttcaataagattccttcgtctaataaagcattttcagtttcgatagtgccataaacagcatcttgaaaaactgttgttcctgtagctggaatcgtttggcgaatggtaaaagattcaccatcagcaattcttttgcgagcttcttttagacttatctttttacaagggtcatggtaaagatattcaccgttttcatgatgatctactttttcacggcaaaagcagtagtgagcccaacctaaatctactagtttatgggcatattcttgatatatggccaatctttctgattgaatataaggaccaaagtttccaggatttaaagggccttcatcataatttaaaccggtattttttaaaacatcataaataatatcaacagcaccagcaacttctctttgttgatcagtatcttcgatccttaatataaattcaccgtcttcatgtttagcgatcaaatagctgtatagagcggttcttaaattacctatatgcatatagccagtaggactaggtgcaaaccgagtacgaattttttgcatttttttaaatttctccttttctttttctaaaaaaagtagtaaagtatatatagacattggggtgtagccaagcggtaaggcagcagactctgaatctgccatttccctggttcgaatccaggtaccccagccaaatataaaaattaagcaggaataagttcctgctttttattttaatatggtagcctgtagggggttcgaacccctgcatgctggaatgagaatccagagtgttaaccacttcaccaacaggccatcgtgtaaacatattatagcactaaattttactaaaatacagtcttaattttaaattttatatacgatttgtaatcatggcattaatcattcaaatattttaaactaaaaagcttattttatataactagtgaatcttgatacaatatattttttaatagagttgtaatatgatagaaaaagcaatacaattcattatttgcatgactgtttctattataccatatctagtatatacttgttttacttaaatatattttgatttttagatattatgatttaattaataaattagatttgattcaatgagttttatagtcaatgaaaataaaataaggtataatgtatatatgcaaaagggatgatagaaatgaaaaaagcaattccacttggaataatggattatgaaaaactaataaaagatgattattatgcagtagataaaacattgatgatcaaagagtttcttgaaaggaaaagcggtgttacattaattacgagaccaagaagatttggcaagactttaaatatgtcaatgttagctaatttctttgatattaccaaagactccaaagaattatttaaagatacagagatcatgaaaacagaatatgctgattacatcaaccagtatccaactatttttatcacttttgcaggagctaaaagcagtttacaggaaattgtaagctggataaaaaaagtaatcttaaaagaatatcaacgttataaatttattttaaaagatttagatgaatttgataaatcagtttatgaatcagtaaagaaaggactatttaattttaataataatcaattaaatgatattgttgatgctttatcatttttaatggaacagttagaaaaatattatcaaaagaaagtcatgctgttcatcgatgaatatgatacgccatttattgaagaacatgtaagtggttaatctgaataaaaaataagaacggaaaataatgttttacctaaaaaagtgcataaagcccctttccccaaatggaaggctattctgtctgaggtgagttgctagatttcttgataatgaattgtagaatttcttcatcactcaaaccagtgcggctgagctgattgaaagcatttcttaaattgtttttgatgtattcgatacgctgttgttttgttgtttctacgtctgccatatcagatgggttgaaaacctcacctgttttaagaatgtgatagatggctacaagtatttttctggcaatagctatgatggcacgctttttgccacgacgttttgaaatcctgctgaatttgtctgcatagtaatcacaatttttgtctttgacagcagcgtgtgcaacctgtacaaggcatggtttgatataaacacctgccttggaaatcttaactgatttctttttaccagcagactcgttacagccaggtgcgagtccagcccatgcggcaagcttacgatgactggaccactgtgatacatcaatacccagttctgaaatgatgataattgcagattttctactgacacctggaatagtcataagaagctggatatagttttcataggcagagaccattatattaatatgatgctgaatctcatcaagaagagaatcaacatattccatatgtttctgaacgattctgattcttgacttctgataatgattcaaatcagtgccttcaacagcactgagaatatcttcatcagaagatttacatctgccatgaactttagaaagaatgtcttcactggtatagggttcatctgataaaatagtatcgacaatagaggaagcggatttaccaaagacatcagaaaaaacaagatcaatcttacagtttccaacagtcagggcattttggaaacgattcttctcagaagaacggatattgacaagcttgaactgatagcgagtaaattccctgaggatacggatattcttttcagggatatagctagatctgacgataccgaatttaaagagatcagcgatccatttggcatccttgttgtcatctttctcacctttgatagccttgacccatttaggattggcaacaacgacattggagatgtggtcctccaatgcattgtatacagggacatagtatttaccagtggattccatgcatacattttgacagttgttatcgataagccattgtctaaactgaatgagttggttattgaaggttgagaatctttttttaatatacctgggtttgacggattcagagatgcagataacagcaacaatgaaagacttatgcacatcaacgccacaggctctagggtaaacgatttccataaataaaaagctcctttcagaatatagagaaggagctcagtgactgactgaacaacactaaaagattaactcaagtcaatgattaatctacagactcaaaagacatactcatgtgtgcttgaaaagttcagccctgcactggttatgatactgttttgaactgaacgagttgcagaaatctacaactcacctccccgtgctttgtagtgtaagactccttcagtaaaaatataaaataaaatgcctgcacaaacaagactttattcatgactatgtgtgccttggagacgcaggcggaaaggaatgtaaggttatgatgaaataaaaggcgggttagcaggattacttcataatgctttaaaactatcaccaagccttcagtatgcgatgcttacaggaattcagagagtagccaaagaaaatatcttcagtgatctaaacaatcttatagtatgtacagtaatggatgatgaatatgatcaatattttggttttactgaaaaagaaacagaagaactaaaaagcttatcagatatagcaggcgaacagatcgttgaaaaagaatatgataaaggattagaagaaaagataatctatataggattagctcattgtggtaaagaggttgtggtgagttggaaagaaaaaatagttaataactaaagtttaatatttgaaaggagatcggctatgaatctaaaaaaacttcatcatgttgcgataattggcagtgattataagaaatcaaaacatttttatgtagatttattaggttttaagataattcgggaaaattatcgagaaagtagaaatgattataagattgatttgcagctagatgatatcgaattggaattatttattgccacaaatcatccggcaagagttagttatcctgaagcatatggtttaaggcatcttgctttttgggttgaatctgtggaagaaacggtcaaggaacttaatgaaaaaggaattagtacggaacctatacgtatagatgactatactggaaagaaaatgacttttttctttgatcccgatggattacctttggaaatacatgaataatgtgtatataataaaatttaaaggagattgattatggtaattattgatttgatactttgtttagctgcaataatttttgcaataattgcagccattaaaaaatacagaaaatttaatgttttggtagtattgagctatgtatgttattcgttagcgatattgtattcattgtatgatatgataactagagtaaatagcaatgatattgctggaatcctggatatctatccgattatgattatcggatatcttattgttcttgtaattgttacaatatttaacttatatgcggttttaaaaagacgaaatacgatagattttagtttattgaaataaatatattgaagctaaaaaggaatttagatgatgtaattattgtaacttgtataatagaaatatatatttgctgttatttgtgaaaaattaaggggtgagatcataatggtaaataaaaaaagaaagaatgtcgttttactccatgcaaagtcagtaagtgtttatcatagttgcatggagtaataaaggatagtgctggctttgcaatttgatgataaaaagttaaaggagcgagcttgcatgaaatatattaaagccgattcaatacttcctgttgctttagttgaagaactacaaaattatatccagggtggatatatttatattccttcaaaaaaggacaacaaaaagaaatggggcgaattgagtggttataaattagaaattaaacaaagaaatataaagataaagaaagattatcaacaaggaaaaagtattgatgaattagctgatagctattgcctttcagtttattcaattaaaaaaataatttatcaaaaatgaggtcgtattttaatacgatcttttttgaataaaaaacaattctgtaactaattatatattgaaaacagtacttttggtgatattatctaattggtgatggataatgaaaacaacaaaattttatcttgcaaaaatccccgttattatatggtccgtagaatcagacaaagtattcatttatgttcatgggaaaatgtctaataaagaatcagctgaactttttgcttcaatagcgcaaagtagggaatatcagacaattagtttcgatttaccagaacatggagagcgaaaagatgaaaattatcgatgtgatgtttttaatggtgtttttgatcttaggcaaataagtgcatatgctttagctaattggaaaacagtttctttatatgcttgtagtttgggcgcatattttagtttgcaggcatataaagattgtatttttgaaaaatgtttttttcttgcaccaattgtcgatatggaatatctcatcaaaaatatgtttaaatggtttgatattactgaagaaatactgaatactgaaagagaaatttctacaccaatagatatcttaacttgggattattatcagtatgttaaaaataatcctattgtaaggtggagtagtccaacctacatcctttatggaggaaaagataatttgcagccgttttcagttataaaaaattttgtgaaatctacgcatgcaaaattaactatatctaaacatagcgaacattcttttatgaataatggtgatgatgaagtgataaagaagtggttggataaaaatttgtaagcagatcatgacgatctgcttatttaagattattttgaattttatttaagtacatactaactaatttagtaagaataattaaaatagggatagcagcaatgatagttattaaaatataactgatcaattttgaatttaaactatgcatttgtagtaatgaccaaaatattggcgtagataaaataaaaccaattatatcaataactagtacaccaccacgataccagttgagaggataataaattctatagatcatatggatagaaataaaagccgttgtaaaatataaaactgtaaatacttccggtagtgacaaatggagtaatggggctaataattttattattgcaacagttaaaacgattgttagggcattaggtagtgagtaacgcaaagcatgatgtccaatcgattcttttggtttttcaatatttcgttcaaataagatcataaatgatggaaaaccttcgataaacatatctaataaggtcatttgaaaagggataaaaggataaggaatatttaagatgatcgataatatagaaagtaagatagtatagatcgtttttaaataatacattgaagcagaacgggtaacattgttgataactaaacggccttcacgaactacttcaactaatgtttctaacttcccatcaataatgataaattgagcaacttgtcttgcaatatcagatccggatcccatagcgattgacacatcagcatcttttagagctaaaacatcattgacgccgtcacctgtcatagcaactttttgtttatgtttttgtaagcaaagaatcatttgatgcttttggaaaggcgtagcacgacctatgacattatagtttaaaatagcatcttctaattcttgatctgttttaattgatgaagcatcaatatatttatcagcattattgacaccagcaagttttgcaatagcacttactgtagcgggattatcaccggaaatcactttaatatcaacatcattttcactaaaaaattttaatgtttcttttgcatcttttcggattggatctttaataacaatcaagcctaaaggaattgttttattgagcgtttcttgaagcatatcgatattttcatgatgaccgatcattaaaattcgcgcaccgcttttagccattgccgtaatcttttgaggtaaaggatactcaggtttaatgatttctggagctccaacaataattgttccaatcgtttctaattcaacagcactccatttacgagctgaagaaaaggcaatcctatttaatgttttataagtactcggttcattaaaataattcttcaaagtcttaaaagttatattattatctaatgaaccagcaacaaacgaactcataattttatttagatcatacaaaaaggaattatcaagttcaacaacttgttcaatttccatctttccttcagtaagagtaccagttttatctaaacataaaacatctattcttgataatgtttcaatgctaaacatctcttgaacaagcgttttttgcttacccagtttaacaacgctggcggctaaagagacactagtaagtaagactaggccttttggcagcattcctaaaagggcggttgctgtattaacgatcgtacttgtaatactttgatcacgaattacataagcttgataaagcatcaagatacttaatggtaaaactaaataactagtatagcgagtaactgtgttgaatgtatttaataattctgagttaactggttttcgcgtccttgcctgatcggtgattttactagcataattgtctttgccaacatgaattacttttgctaagcaggcgccacttaaaatgaagctgcccgataataacatatctccaggattttttgtgacaggatcggcttctccagttaataatgattcatcaacttcaacactgtttttaacaactctagcatcagcactgatttgattaccagtttcaaaataaacgatatcatctaaaacgatttcttcgttattgattgaaattgttttttcttcacgaattacttttgtttttggtgagacgatcaaatttaatttagcaaccatgttttttgatttgatttcttgtttagctctaataacagtattagaaacaacgattacaacaaaaaacaagcttgaatatgctttaactgcaattaaagctacagcaataataaaattataagcattgaataaattaaaaatatgacttatgataatttgtaaattacttttaacaacaggtttaggtgcaatattaattttacctgctttaattcttaaatcaacttcttcattagtcaatccggttattttttccatcattatttcccctataatatataattaataattgttatttataatataactaagatattaaaatttcatcataaaaaaactaaagaatttcttaaatactcttaaaatcattaaaatactttttattactaatgttatttattaataaatttgtttataatattcatataagttaaataaataatcatagatcaaagcaaaggggaaaataatggcaaatataattgactatataaaatggcgtggtgatcttgatttacagatcgatcctttcaatgatattgatggactaattttaagtgaactggcatatgttgattttgataaaatagtaccgacttttttatcaaaagaaagtcgaagtttagaagatgtagcaaatgatttttttaatttaaatgatcttgataaattgatggatgaattttcttttattaaagatgctatcattttattaaaaatcgcagctaaatcaaaacgatataaaaatattttattatctgattatttaaatgaattagattatcaggctgttaaacaatttgcagcaataacttttcaattaccagatagtagtatatatgttgcatttaggggaactgatgatatgattctaggatggaaagaagattttatgatgacttatactatgccgatcccttcacaaattagagctaaagaatatttatctgccattgcaagaaaaaaatataataagagtttattttatttacttaaaaatcgtagttttcaaactagtgttttaaatactataaagaattattttaaccaatatttttttggtgtgaagatgcgtttaggaggacattctaaaggtggaaatctggctgtatatgcagcatgtaatagcagtgaaaaaataataaacagaatcattgaaatttataataatgatggtccaggatttaatcaagaaatcttggaaattccggagtatcaaaagatagctaaaaaaatcaaaaaatttgttcctgagggctgtgtctttgggataatgcttgaatatcttgaagaaatgatcgttgttaaaagtgatgcaaaaggattaatgcagcatagtggttttacatggcagatcgaaggtactcattttgttgaaagcaaagcgattaatgcagagagtcaagcaatggatacagcatttaaatcatggcttgttaaagtggatgaagaaacgcgaaagaatgctgttgaatgtctttttagtattatcgaggctgccggaataaaaaagataaatgatttttcagaaaaaacatttacacatttaattgttgctttgaaggaactaaaaaatatggatagtgaatcgcgaaatgctttaattcaattttttaaagtgctattagtagaaaataataatagtcgcaaagaatataagaaaaataaatcttaattcataatctattaatattattaaattatagtaaatatgaaaagagggttaatatgaataaatttcaaaatgcattatatcgattcatggcaggaagatatggttctgatcagtttaatgtctttttattagttctagcggtagtaataatgtgcttaaacttgttttttattagaagctcatttctttcagctgtagtatggttattacttatttataatttgtttagaacatattcacgtaatatatataaacgaagagaagaaaatgaaaaatatttaaaaatgattcaaccgatcaagaaaagatttaatgtaattaaaaagaatcatcaagataaagaacataaatattatttatgtccaagctgtaagcagatagtcagagttcctaaaggacgtggaaaaatcacgataacctgtcctacatgtaaaaatcgctttgataaaaaaagttaatattaaaaaaacttaggctaaataaacctaagttttttagtaaaacaaaatcaattgactaccaaaaaatgttaaatagaagattggattctttttaaatgcttgatcaaaatcacgattaacttttccaaaattatttgatcactttcctggaaacggtcaaaactcgttgaatcaagatctaaaacaccatacaaattttgatcaattattattggtagaacaatttcactattactggcactatcacaagctatatgtccaggaaaatcatgaacattagcaatgcgtttagtctttaattcggtggcacatgcaccacatacaccgcgatcatagggaatgatagtgcaagcagtcaatccttgaaaaggacctaagatcaattgttgatctcgattaagataaaaaccagcccatgaaacatcttcaaattcttgtttaataaaagcactcatatttgctaataatgaaatttcgtaattaatattttctaataaagcatctaattgtttttctttcataaaatcaccttctatattatacattatttttttctattttgtttaaaaaaataaaattggttaaaaatagtagtagaaaattataaaggagaatacttatgaaaaaaataataaaatatttattttgtttaacattattatttactttagctggatgtgctaataataatgatgatgacaaaacaaatgaaactaacaattcaacaaatgaaacaacaaataatgatgattttgatgatattgatacacagatcaaaaatcaatttagtgatgattatgaagttaatcgagatgatgtaattgatgctgttaattatattaataataatcttgataatgtaaaagataaagaagttgcaaaaaaattatatgaaaaaggcagttatttagaaatggcagcaaattatggagacgtcggtgaagatgatacgattcgaaacctaggaattaaagctaaaaattatgctaataaagtttatcatgccagtgatgatgaagttgataatgttatcagtgatgccgaaggtgattttgatgaatttacaacgaaactaggtaatggaattgataatgcagtagatgattttatgaatttttttgagactaaaaagactaatgattaaagggatctagtgtcccttttttagtttggagtagatgattaaaaagtaagttataattgacttataaactattatgcattacgatgtagttaaatagtatttataatgtaatttttacgaatgtttttagagtataagatggcttattttagcaatcttgaagatttttaattatatgaatatgaaatatcgcaaaagttaaatttttatgggtttgaaaagatttctgaagatacgatttatccattattattgaggttagaaaaagctaatttaatatactctattattcatgaatcaaaatcaggttctaaaagaaagtgttattttttaacagatgaagataaaaataattaaataattttaaaataagttatgattagttgactacgacagtaaataaactgttaaaaaatgtaatggatgcttatatcttatattggtgtttggatgaattatattttaagattatattagtttagaaaggttaaagaaaatgaataaaaaaatatggaaatttatactattaatattttctattatcttcttatttttaaaattatgggttccttttggtaaaaggccatcaaaaaaagatcgcttaaattatgcttcaagagctaaaaattttaaacataataaattttataatgaaaataagtatcgacgaatatatattaaagctaaaaaaaataactatctttcgataaaagataatattcctactgataaaattatcacaaaaactccaaaaatcctaaaaaatccggatgatgaaatattaactattacatggctaggacactcttctatcttttttcaaatgcatgggatgaatattttaattgatccagtttttagcaatcatgcttcaccatttccttttccctcaatgcgtcgatttagtgctttacctattaaaatcaatgattttgataagatcgatattgtagttataactcatgatcattatgaccacttagattataaaacgattaaaaaaatagataaaaaagtaacaagatatattgttcccttaggggttgaaaaacatttagaaagatggaaaataaagaaagaaaaaattatcagtttagcctggtgggaagaaataagaataaatggattattagtagcttgtacgccagctagacatagttcttttagaaattttattaatgacagttataaaacattatggtcttcctgggtgtttattgatgaatatcataaaatattcgaaagtggcgatactggatttgatagtcattttgaaaaaatatccaagaaatacggtgactttgatttagcagttttagaagcgggacagtataatgaaaaatggcgagctacacatatgacacctgaagaatcggtaaaggctgggatgatcttaaaagctaagatgatcatgccgattcattggggaacctttagtttagccgatcatccttgggatgatccagtagaaagatttacgaacaaagcggataaagaaaatatcaagtggatcgttcctaaaattggcgaaaccattgcatatggccatgatctttatcaaagtaaatggtggactaatttaaaataaaagcagctttttcgctgcttttatttatgaatattatttaataaataatatgctacactactgtaaactgtagttcctgtcaaaagaacattttcattaaaatcataggcacaattatgtggtgaagctgctagatcagtagttaatttcatataggtggcaattcctccgtgtgcttgaacagtagccatcatataagaaaaatcatcactaccatctaaaggacttaaatattttggagcaactttaatattttttaaatgatcatcgcagacgtggcgaattatatccatcatttttttatcacattcaagtgaataagctttccccattttattgatttcaacaatagtatcatgcattaaagcagctccgcggattacatcagtagcatatacttccatataattgtttaattctgtagttgctccacgtacttctatttctaactttgctgtttcgggaacaacattacgtcctgttccggcgttgattgttcctacgttgattcttgtacagccgtcgctattacgcggaattgagtgaagattcaagatacatgaagcagctgaaagaagggcgttttttccaaattgaggcataccagcggcatgagaagaaaccccatgatagattacatctaactttgttgtggcaaaagtttcatccatacctaaataaatatcataatcttctcctggtgcctgttgccaaatatgtcctgcaaaaatgtaatcaacatcatctaaaaaaccgcttgttgcaatacttttggcacctcttacaccttcttcagccggctggaaaataagctttagggttccatgaagatgttctttgatttcacttaaaattttagcgacagttaatcccatagctgtatgtccatcatgaccacaagcatgcatagctccaggattacatgaaataaagccaaatttaccaggattgtgatcagcagaatcatcctccataatactcaaggcatccatatcaaatctgatagctacaactggaccatcaccattttttataattcccgctactgctgtaaagccatctttcactttttctaaatagtaggggtcagctccttgtaagatagcccgtttataattgagtgttaatacacgtttactaggcagccccattcttgccgtttcacacatcaattcttttcctaccaatacttgataacccaaattatttagttttctagctacgattgaggcagttcgcatttctaaccagcctctttctgcatatttatgaaaatcacgtcttgtttgaactgtttcaggaaaatattcttttgctaaagatttaattttttcatacatattcattccttctcctttattatattttagcaattttcttgtatcttttccaataatacatcatttgaatttatagtttaattttatttttttatatttattaaataattgttctaataatctaaataaatatccagagaaatcaactaataaaggagaaaaggcaattaatgctaataaaaccatcagccagttaaaatctagccccgtcaaatctaatatagattgtccaatgatcatagaaatataataagccatttgggtcgtatagataataatttttcgataacgggtcaaaggactataaattcgtaataaagcaatcgtataattacaaccagtaaataaaatacaaacagtagacagcatattaggatcatagtctaaatacagaccgatattagttatcaaagtagttcctaaagcaatcgtaaaagctgaaggaaatgatttttctaaaacatttttaaaaaaattgccttttacatgcgcaaaatttgcttcgtatgttaaaaagaaagtaggaattcccaccccacaggcactgatcaaggataattgaatcggttcaaaaggataggcttggccaaagaaaatcgttgaaattgaaattaagaccgaaaagattgttttaattaaaaacattgatgccgacattgtaatattattgataacgcggcgcccttcatcaacaatataaggcatagcattaaaattattatttaataaaactaagttagctgtattttttgcggcatcacttcctgaagccatagctatcgaacaatcagcttctttaaaagctaagacatcattgacaccatcaccagtcatagctacagtatgacctagttgctttaaagctaagaccatctcttttttttgttgtggggtgacccgaccgaaaacagaataatttttaactgctttttgaatatcttttgctgttgtcaattttgttgcatctatataatgcctgctttttaaaccggctcttttagcgatggcagagacagttattggatcatcaccagaaatgattttcaaatcaacgccttgtgattcaaaatagtgcaaagtttctttagcatcatctcttatgacatcgcttaaaacaattattccacatggttttaaatcagacggcaaactttcattgttgatgattttatttgtatgagctagtactaaaatacgatagcctttacttgtgtaatcaaagcaaagttcttctagatcctcatctccttgcggaaaaagaaattgataagccccaagataatatgtaccatggtcataaaaagaagttccactatatttacgatcagaactaaaaggaataacatgacagggtttaaagttagttttgcagggataatgttcttttaaggcttgagctgttacattaacatcagtcaatgtatgcattaaatttcccataatttcttgaaaatcaagattacatgttttaatatcaaactcaactttcattgttccttcggtaattgtccctgttttatcaaggcataagacatctacccgtgctaatgtttcaatgcagaacaattcttgaactaaagtcttttgtttagctagccttaaaacactaagcgtcaatgccgcgctagtcaataatacaaggccttcaggaatcattcctaaaaccgcagcaacagtactaacaatggcatcattaaagccttgttcactatatataagttgttttaaaaacaataatccgccaattggcaaaataaagatacttacatatttcaaaatggtatttaaacactgattcaattgcgaattatgttttttcaaacgtttcgcttcattagtgattttattcatataattatcatcaccaacatgaataactttgcatattccttttcctgaggtaataaaacttccagaaaaaagatgatcgccattttgttttaaaacaggatctgattctccggttaaaagagcttcatttgtctccatttgaccatctacgagaatactatctgcgggaatctgcataccagtagttaaaactagataatcatctaaaacaatttcatcaatcgaaatttcttttagatgatcatcgcgaattacttcaacttttgctgttgttatgatcgatagacgatctaatgttctttttgctttaacttcttgatagatacctgcaatcgtattaatgattataactaaaataaagagggtatttttataagattcaacaaagagaactaaacctaataaagttgcatttaaaatattaaaaaaagtaatggtattgttgagaaagatttctttatacgatttagtaattttattgtttatatgattaatttttccttcatcagttctttgtttaacttgaagactagttaaaccaggataattttgattatttatcttcataatatcaaccacctttacaactcattttaacttaattatagtgattaaacaattaattttgcttaagaatgtttaagagatttaagatattttgtatacaatctttgttataaattgtatacaattttattgaatgatgctataatagaaattaattaattttagggggtgcttatatgagtagatttatagacggttttattgaaaaagcaagagaaagtaacaataaaatcgataatgaattatattcaaaatatgatgtaaaaaaagggttaagaaatgaagatggtacaggagtattagttggattaactaaaattgccgatgttgttggttataaaagggttgaaaataaaaaggtcgattgtgagggtgagctttattatcggggtatcaatgtttctgatattattaataaaagggagccgcatcaaagatttttatttgaagaaacatgttttttgattttgtttggttatttaccaacggttgaagaattagaaaatttcaaaaaagaattatcagatcgttatgaattaccgccacattatttggaatcaaaaattttgggattcccttctaaaaatctaatgaataaattacagcaggaagttttgatgctttattcatatgatgatgatcctgataatatcagtgcttcatcaacaatgtataaaggattaaatttgattgctaaaattccttctattgtttgctatgcatatcgtagtaaggtgcattattttgataaagaaagtttatacattcatcaaattagacctgatttatcaattgccgaaaatattttgtatcttttaagagatcataaacattttacacctaaagaagctgaagttcttgacatgtgtcttgtcttacatgctgatcatgggggtggaaataactcaacatttactaatgtagtaatcagctctacaggaactgatatttattcaagttttgctggagcaatcggttcattaaaaggtcctaagcatggtggtgctaatttagcagttatgaaacaaatgaaattagttattgatgaaataggcttagaagctagtgataaacaaatcgaaatgattattgaaagaatcttagataaaaaatttaacgataatagtggtttgatttatggtattggtcatgctgtttatacacttagcgacccacgctgtgttattttaagacaacagtgtaaagaattgtcattagaaaaaggacgtgaaaatgaatttaatttttattatcgttttgaacagttagcaattgaagcaataaaaaaacgtaaaggaattacggtatgtgctaatgttgatttttatagtggcttaatttatgatatgttatgtattcctaccgaattatatactttaatgtttgtggtaggtcgagcagtaggatggctggcacataatattgaaaataaattatattctggtcgtattattcgtccagccgccaaatatgttggcgaaacatatgaatatatcccaatcgataaacgaaaataaaatgatacttcttttatcattaagaaaaaagttgtttatgtaaaagaatttaaagcttgattgtgtttttgaattttagaatgcagcagtaatattaatttcatcaagatagcttgatgaaattagtgaaagtagataacaatttaaatataaatgctattgttgataaagatgaagtatttattaatgataaaaaaacgtgttagttacataactaaatttataataagaccacagataaagtctgtggttttattatatgaatcagtataagatcataaactttataaaaaaacagatcagtttgactgatctgtaataatgtcttaattatttaatgtgacgaacccaaccgtatttatcttctaaacgaccccattgaattcctgttaaagtatcataaagtttttgtgtcaattcgccagttttaaagttattgataactacttcttcacctttgtaataaagctgaccaactggtgaaataacggctgctgtacctgtaccaaatgcttcagttaattttccattacgtccagcttccattaattcatcaatactaagttcacgttcttcaactttatatccccaatctttaaggatatgaataattgaatcacgagtaactccaggcaatactgatccttcaagaggagctgtaacgatagtatcatcgatcaaaaacattacattcatagttccgacttcttcaacatatttacgatgaacaccgtcaagccataaaacttgggtataaccatgagcttcagctttcacctgggcagcgatactagcagcataatttccaccgcattttgtaaacccagttccacctttaacagcacgtacatattcatcttcaacccaaatttttacaggattgacaccttcaggataataatttcctacaggtgataaaataattacaaatttataagttttagcaggatgaacaccaaccccagcttcactagcaaacataaatggtcgaatatataatgatgtatctttagccgtaggaatccagtcttgttcatatttaacgattgcttcgactgcttcaacaaacatttcttctggtaattctgccatacaaatacgtttgtttgaattaatcattctacgagcattcatttctggtctaaataatgtaatatttccttgaggatcacgatatgcttttaatccttcaaatgtttcttgagcatagtgtaataccatagtagcaggatccatagcaataggtccgtaaggaacgattcttgcatcatgccatcctttaccttcagtataatccatcataaacatgtgatcagtaaaataattaccaaaacctaaattattttgatctggtttttcttttagcgtttgagctctttcaatcttgatttccattgttaaaatacccccttaatttatctataagtatactcttatttgagtcttgttacaagatagaatttatctaagaaatgcagataagatatgatttttatgaaaaaaagtgtttaattatagataaagatattttttgttgctctttttaatggaaaataattgaagaaatgaaatttatcgtaagacaaaggaaataaatatatagatctaagtgttgtaatcataagatattgaattgcttagtaggtaatttatacgatataaaggataatcattaatggtaaaatattaaagaggattaaaatatgaggggatcaaaacgacttatgtcttaaagaaatgtaaaagttatttttttagaagaaataagtttgaagtagaatttttgtaaagatactgatcaagagataaaagtttaatttaaaatcaaacagctattctaaaaaacattaattatatgggtagattttttgttatttgtataaattaaaacttgtatattgtataattagctgataatcaatataatatattttaagatgaggcgggattttatggacaagataataattagagaagcaaaaactgaagatgctaaagaaataattagttatttaaatcaaattggtggagagtcagataatctattatttggttttaatgaatttaatatgtcagttgaaaatgagatggcttatattagacgaataaatgattcaaataaagattggatgttaattgctttaatagatgatgaaatagcaggtattgcttcattacaaggctttagtcagattagaatagaacatcgatgtaatctagcagtatcagttaagaaaaaatattggcatcagggaattggaacacagcttattaaaaagttgattgtttgtgctaaagaaagagaaattgatgttattgaattagaagttagatcagataatcttaatgcaatcagtttgtatgaaaaattaggatttgaaaagattggttattatcaaaagttttttaaaatcaatggagaatattatgatgcttatttaatgaatttgtacttgtgaggatagggtaatgatttatcaagaaaatgtattaacatgtgatatttataatcaaattagaaatagtgtagggtggtctagtttttccaatagacaagctaatagcgcaattgaaaatagttataatatagttgcttttgatgatgataaggcagtaggaatgggacgtttggttggtgatggaatttattatactattgttgatgttgctgttgatccccagtattggcatcgaggaataggacagatgatcgttaagaaactccttgatcaggctaataacaatctatttaagaatgaaagatgtactattaatttagttgtagtgcaagataaagaagaattttatactaaactaggatttaaaaaaatttctgatgaaaattgtggatcaggaatgaaattaacattaaaaaaataactgtttaaagatatttgttgattttatctgtttgcttttatgaaaaaatgtttttaaaagaaaataggggaacagtattattatctaaaataagttaataaaagtggataaaaaaataaaggatatttaaatgttatcctttatttttatgtgtaagtttttcattatatcaagagctttttgctccaagacaggatcattactagcaattccttttggatcaataattattgttgtttctggcagagctgctttaataattatggcattggaaataacacagatattagaaacaacaccaactagagtaatttcctcatagtctttgtcttttaaataattacctaactctaatgatccaaaagtctcttttaaaatttttttatcatttacagcaagttcatttattttaccatataactgccagcctttactattttcaatacaatgagttattggtaaatttttgccttcttgtgtttctaaataattttcttgatgtgtatcatatgtgaaaataacatcatcattgttatgatgatatctattaattaaatcaactaaatattcttctagtgctacagctttttcaaatcccaaactaccatttacaaaatcattttgataatcaattacaactaataattttttcatttcaagcctccatcttttggactcattttaacattattaatcaatgatgtaaatatgtgattaaaggtagaccattatcaaataaagagttaaaaaatttataatatattggataatttagtcgataaatatttatagttacattaaaaattgttataatatcttctgtatctgtaaaaaagaggaatatttaagtaagagatggaaagaaagtcacaatttgtgaatatcttgtgacttttttgatgtttcagttatatagttaaattaattgtattattaggttaaaatttagttttatacggtagtaaaaaattatatgttaatgaagttaaataatattttagttgtaatatatatgtagcaggtaatttaaataaggagggatatcatgacattagataaattgacaccaggaatgagtggtaaaattactgttgttcatggagaaggactattacgacgacgtttactagaaatgggtttaactcctaaaacagtagttaaagttcgtaaagttgcgcctatgaaagatccaattgaattatatttgcgcagttatgttttaacgattagaaaagatgatgcatcaatgatagaagttgaggtgattgataatggtaactaaaacaatcgctttgattggaaatcaaaattgtgggaaaacaacactttttaacgctttgacaggttctaatcagcatgtaggtaattttcctggagttacagttgaacaaaaatccggctcaataaaaaaacatcctactattaaattagtcgatcttccaggtatttattcattaacaccatatacgatggaagagattgtttctactgattttttaatcaaagagaagccctcgatgattattaatattattgatgcaactagtattgaaagaaatctatatttaacaatgcaattactggaactgaatattccgatgattttagctttaaatatgatggatgaagttatcagcagtggtaactgtattgatgttgaaggcttacaaactgctttaggattaagggtagttcctctttcagctagtaaaaatgagggaatcgaagaattgattgaagcagttgaatcgatattgaaagaaaataactgttcccatttagatctatgtagtggcgagattcataaagcaattcattcaatcaatcatttaatcgaagaaaatgcgataaaagctaatcttcctaaacgattcgcagttaccaaagtgatagaaggcgatcaagaaataatcaaacagttaaaattagattcccaacagctgcatattattgaacatattatcaaggatatggaagagaaggagggtcttgataaagatgctgcattagtagaaatgcgctatcaaatcattgaagatattactagtaaaacagtctttaagcaacaagaaaccacaggacaaatacgctctgaaaaaattgatgcaatcttgacacataagtatttgggaataccaattttcattattataatgttatcgattttctttctgacatttaatgtaattggcgctccattacaatctttaatggagctaggcgtgaattttgttggggatacattaataacattcttaactaatcatcaagttgctccttggttgatttctttattagaagatggcgtgattgctggagtcggcagtgtcttatcatttttaccattgatcgttgttttattcttctttttatcaatgcttgaagatagtggttatatggcgcgagttgcttttgtcatggataaattattaagaaaaattggattatcaggaaaatcatttgttccaatgctaattggatttgggtgttcagttccagcaatcatggcaacaagaactttatcatctatccgtgatcgtaaaatgacaatagttgtgacaccgtttatgtcctgtagtgctaaattaccaatttatggaatgatcattactgctttttttagtactaaagcaccatttgtaatgattacaatttattgtattggcattttagtagctattttttcagcattattgttaaaagcaacgatttttccaggtgatccgattccttttgtaatggaactgccaagttatcgagttcctactgccaaaaatgtaattatgcatatgtgggaaaaggcaaaagattttttaaagaaagcttttacgattatttttattgcttctttgttgatctggtttttacaaagttttaattttagatttgaaatggtcaatgacagttcaaaaagtattttagcttttattggaaataaactatcatttatttttgctccattaggtttttccaattggcgtttatcaaccgcattgattacgggaatcacagctaaagaatccgttgtctcaacattatcagtattaactaattcaagtagtcctgatgctttatatcatgctttaaatggcttacttacaccagccagtgcttttgcctttttaacctttacggttttatatatgccctgtgttgctgcctttgctgcaacaaaaagagaattgggttcatggcttcaggcaattttaacagtattgtatcaaaccggtgtagcatacgttgtagcatttatagtttatcattttgctttattgatttcttagtcaacaaataatataatattcgtggatatttttgaaaggacttacaattatggatgagaatttgaaggaaattattaagattagagaagatagaatgatcaaagcttttaatcaaaataatatgcaaataacatttgtagataattttgaacaattacataattatttaaaaagatatttatgtaaccaaaaaacaattgcattggggggatcgatgactttatttgaaactggagtcattgatttaattagacaaagtgatgtaattttatatgatcgctatgaagaaggattgtcaagagagcagatgcaggaagtatttagaaaagcttttacaagtgatatttttattaccagcactaatgctttaacaactgatggttgtttatataatgtggatggaaatggtaatcgtgtagccgcgatgatctatggacctaaggaagttattgtaattgcaggaaaaaataaaatttttgaaaatgaaactgaagccattaatcacattaaaacaattagcgctccagctaatgctgtacgcttaaataaaaagacaccatgtactaaaacaggagtatgtatggattgtttatcgccagaacgtatttgcagcagttatgttaaattaggatatcaaggtaacatcgatcgaattaaaatagtcgttgttaaccaggatttagggtattaagatgaattgtggagttttattccctttatctagttttccatcaaatcatgggattggtgatttaggcaaaaatgcttatgcagttattgatgctctagcaaataatggcgcagattatttacaaattttaccatttcatccttcaactcaagctaattctccatatcgtggagtaagtacgtttgctggggatgaaatatatatcgatttagaacagttagtagaaataggactgttagatgaggttccagaatttaatgctgatgcaaagatggtttattatgataaaattagagcgtttaagcataaatatttattaaaagcatataaaaattttagaagtaatgatgaatatgatctttttttaaaaaaatgtccttgggtatatgattatgcattatattgtacttttgccaatatcaatgattcatacgattgggcttcatggccccaggaatttaaacggtatcctaagtttcatcaagttgatttgagtaaatatcaagctgaaattggatattatcaatttgttcagtatattttctatttacaatggtttactttaaaaaaatatgccaatgaacatggtatcaagataattggtgatatgccattttatgtggatcatggctctgtagaagtttggctagataacgaatcatttatgttggattctaatggctatcctacagatgtagctggagtaccgccagattattttagtgctacaggtcaatattgggggaatccaatttataattgggaacatttacaaaataatgaatttaagttttgggttgaccgaatcggctgggcatgtaagatttttgatattaccagaattgaccattttagagcatttgactcttattgggacattccggcagcttctactagtgctgttgatggctgctggaaatatgctccaggttatgaattgtttgattgtctttatgcaaaattaggagatatcgaattagttgctgaagatttaggatatttaagaccagaagtaattgaattaaaagatcattatcacttaaaagggatgaaagtgtttcaatttatgcttgatgagggctttgataaagtagacaatagttatttttatccaggaactcatgataatgaaacaatcaaaggctggatcgataatctagatcagcaaagttgtgataaaatcgtagaaactgtaggcgataaactgcctttaaatctagcaatcttagattactgtttacattcaaaggctagtgatgtaattattccgatttgggatctgcttggtgtcgataacgatcagcgctttaatgtacctggtgaagttaatgatacaaactggacttatcgagtgccagatcttatggcagctaaaaagggaattgatttatttggtaaactaagaaaggatgattaaaatgagttttaaaaaaattgatattaatgaaatcgttttaaatccatttaaaacgattggaaaagattggcttttaattagcgcttcaaaagaagataaaatcaatacgatgactgcttcctggggtggcattggagttatttggaataaaaatgtcgtaactgtttatattcgacctcaacgttatacaagagagtttgtcgatgcttctgactattttactttaactttttttgaaggttataaaaaagaattaggtatattgggttccaaatcgggacgtgatggcgataaaatcaaagaggttgattttgatgtagaattgcttgagggacagccagcttttaaacagggaaaaatggtttttatttgtaaaaaactatatcaaggtaaaattgaaccaaacgggtttattgatgacagtcttgatgaaaaaaattatcctgatcatgattatcattatatttatattggagaaattgaagatgcttatataaacgaaaaagaataattctttttcgtttatttatattgattttgtcaataatattactggtgagattatgcagatattagaatatataattgttccgatcatatctttagtcgtcttgtttattattactaagatgatggggtatcgtcaggttagtcaattaaatatgtatgattatattaatggaattacgataggtagtattgccagtgagttagtaatgggtggttttgataatattttacaacctttaattgcaatgatcgtttatgcaattgtaataataactttatctaagttagctgcttcttctttgaaattaagaaaaattattgatggtgaagcagttgttttatatgagaataatcaaatttataatgaggaattggaaaaagctaaattagatattgatgaatttttaatgcaatgtcgtattgctggttattttaatttaaatgaactgcaaacggtagtgttagaaactaatggtagttttagtttttttccaaaagaaaagtatcggcctgttgtagtagatgatttaaatattaagatcaataaagttaaattgccaacggtgttagttaaagaaggaaaaattttttatgaaaatcttaaaactattggacaaaatgaaaaatggcttgaaaatgaactaaacgtacagggaataccgcttgcagatgttattctaatgtttcaagaggataatagtaatattgtcacatacacaataaatgaagtagaaaagaattttgattaaatttaggataaataaaaaaacgattttaattaatcgtttttttattcttttcttttatatttatcatagatgatttttaaacctttaaatgtaagatcagggtcatatacatcaatcaacttagtttcattaaaaataatacgtcccaaaccaccagttgaaataacttttaaattttgtccatattctttttttatttcattaataatattttcggttagaccgacatacccataaacaataccagcctgcatacttgtaacagtatttttagcgataatatttttaggttttttaatttcgatttccggcagttttgcagcttgactagaaagagcattgatactaataccgattcctggtgctgtagccccacctaaaaaatcaccattttcatttacgacatcaaacgttgtagcagtgccaaaatcaataactaagcagggaccgccatagatatagtaagccccagcagcatcgactaaacgatcggcacctagttctttaggattatcgattttaatacggattcccgttttgattccagggccaacaataatcggttcacgatcaaagtattttttgattgaattagtaaaagaatacatgatcttaggaactactgaagcaatgatgatatcttcaatttcatcgataagaatatttgaagcacttaaaaagctcaagagcataaaaccatattcatcagaggtacgttctaattttgttgttaaacgatagttatcgataatttcatctttatcaactagccccatggtaatatttgtattaccgatatcaattacaattaacatgtttttgcctcctgaatttctattaatctttttaaaatcaaatcactcaaattattttttgacattaattcaatttcctgtgtattttcagcagttaaaaaggttactttattggtatcatttttaaatcctgcccctggttcttttaaattattggcaactaaaagatcacaatttttatgaataagtttttctctagcgttttcgattaaattttgtgtttccattgcaaagccacaaataatttgattagttttatgttctcctaaaaaagctaaaatatcatcatttttgatcaattccaaagttaaagtttcttcttttttcttaattttatctttggcaatctctttgacccgataatcaccaacagcagccgctttaataataaaatcctgtttttgataatgttctttaactgccgtaaacatttcttgggctgtttggatttcaataatttttataccataaggaaaatcaagacctgtaggaccagtgatcaacgtaacttttgcgcctaattcaaaggctctttttgctagcgcataacccatttttccacttgaatgattagtaatatatcttactggatcaagggcttcttgggtgggaccagcggtcactaagactcgtttattttttaatggtttagcacttaagcaatattcgatcattgcaatgatttggtttaaatcagcaagttttccacgaccagtatcaccacaggctaaaagtccatatcctggttctacaaatttaatcccataggttttacatctttcaatattgcgctgagtagcaagattatcatacatattaacattcatcgctggagcaatcaatttaggacaagtagcagcaatgaaagaagatgttaatacatcatcacaaataccgttggcaattttaccgatgatattagcagtcgcaggaacaataacaaaacaatcagcttttttggcataactaatatgtttgatttcatagccattatcatcaaaatcatcaattaatactggtttgttgatcaaagctcctaaagtaaggggactaatgaactttgttgcattattagtcataattacttctacatcatattctttcttttttaaagctctgacaagttcacaagctttataggcagcaatactgccgctaattcctacaacgattgttttcatcttaatttcctttctttgtaaacattaataaaggctggcaaacaagaacggcgataaccgttccaacaatggcttctaataaaccgctgctagtaacgattccaattaaatatgccatcagtaaattaaaatcttgaccaattgcttgcgcataactttggccaaaaatcaaataaataccacttaatactaaaatagtattagttaatgcaccagctaaactagcaacgatcattcctgcatatttattccatttatgcttaattacttgttcaaaaataaaaccagtaacaaaaccaatcattactctaggtaaaatagcgataacagcacttaaaatatttccactaataaatggtgaaaaaacaaatgaggttacagtaggattaattgtgttataaaacaaactgctcaaaccgaaaactaatccgatgatcgaaccaccttttttacctaaaataattccggcaataattactggaatatgtagtgttgttgcacgcaatggaccaattggaatatatcctaaaaatggtataaatacaagcagcatttcaattgcaataaacattgcatacaaaacaagatctttagtttttttatttttcattttttcctccactaccgttcctttagatacggtgctaataatattttggtcattaaataattagatagttaatatcaagttattactaaatttttattttaacaacaatgtcattatagtacgatattaactacttttcaatttaaaataatgcattttgattagtttagtgataaaatagcagtcaaggaggttttaatctgaataaaaaataagaacggaaaataatgttttacctaaaaaagtgcataaagcccctttccccaaatggaaggctattctgtctgaggtgagttgctagatttcttgataatgaattgtagaatttcttcatcactcaaaccagtgcggctgagctgattgaaagcatttcttaaattgtttttgatgtattcgatacgctgttgttttgttgtttctacgtctgccatatcagatgggttgaaaacctcacctgttttaagaatgtgatagatggctacaagtatttttctggcaatagctatgatggcacgctttttgccacgacgttttgaaatcctgctgaatttgtctgcatagtaatcacaatttttgtctttgacagcagcgtgtgcaacctgtacaaggcatggtttgatataaacacctgccttggaaatcttaactgatttctttttaccagcagactcgttacagccaggtgcgagtccagcccatgcggcaagcttacgatgactggaccactgtgatacatcaatacccagttctgaaatgatgataattgcagattttctactgacacctggaatagtcataagaagctggatatagttttcataggcagagaccattatattaatatgatgctgaatctcatcaagaagagaatcaacatattccatatgtttctgaacgattctgattcttgacttctgataatgattcaaatcagtgccttcaacagcactgagaatatcttcatcagaagatttacatctgccatgaactttagaaagaatgtcttcactggtatagggttcatctgataaaatagtatcgacaatagaggaagcggatttaccaaagacatcagaaaaaacaagatcaatcttacagtttccaacagtcagggcattttggaaacgattcttctcagaagaacggatattgacaagcttgaactgatagcgagtaaattccctgaggatacggatattcttttcagggatatagctagatctgacgataccgaatttaaagagatcagcgatccatttggcatccttgttgtcatctttctcacctttgatagccttgacccatttaggattggcaacaacgacattggagatgtggtcctccaatgcattgtatacagggacatagtatttaccagtggattccatgcatacattttgacagttgttatcgataagccattgtctaaactgaatgagttggttattgaaggttgagaatctttttttaatatacctgggtttgacggattcagagatgcagataacagcaacaatgaaagacttatgcacatcaacgccacaggctctagggtaaacgatttccataaataaaaagctcctttcagaatatagagaaggagctcagtgactgactgaacaacactaaaagattaactcaagtcaatgattaatctacagactcaaaagacatactcatgtgtgcttgaaaagttcagccctgcactggttatgatactgttttgaactgaacgagttgcagaaatctacaactcacctccccgtgctttgtagtgtaagactccttcagtaaaaatataaaataaaatgcctgcacaaacaagactttattcatgactatgtgtgccttggagacgcaggcggaaaggaatgtaaggttatgatgaaaaaaatagcagttttatttcatgatggatttgaagaacttgaagcattatcagtagtagatgtaatgcgtcgtgccaatgttgaatgtacaatggtaggaatggataaattagaagctcttagcgctcaccaaataaaaatattgatggatcggatatatgatgaaacaattgaaacatatgatgctgttgttattcctgggggaatgcccggagcaactaatttaagagatgatccaagagtaattgagctagtaaaaaaatttaatgttgataataaaatcattggtgcaatttgtgcgggaccaatcgttttagaaaaagcgggagttatcaaagaaaagacagttacttgttatcctggttttgaaacccagttaaatagtgcaaattaccaggaagctttagttttaaaagatggtaatatcgttactggtaaaggtcctggggctgctttggcttttgcatatactcttttagaagcccttggaatagatagttcagcgatcaaagagggaatgcagtataaatatttagaagaaaatatttaaaaatagttcaagatgccaacagggcatctttttatattgacaaacaataatcaacatgcttaaatgagcaatggagatagtatttggcaacaaaactatactcgatctgattcactggaatttcatataaacatagtaaataaagagcttatattttttaaatgggactcaaaaaatacaaataatttgtcatgcattttagggtcatagccctataaatgcttttttattgtattttaaatcaagaaaggatgtatgaaatgacaatagagatgttaaaaggaaaaattcatcgtgctaccgttattcaagctaaattagattatgtcggaagtatcacgatcgatgaagaattacttgaagcagcgggaattttagaatatgaaaaagtacaaattgtagatgttgataatggaaatagatttgaaacatatgctattagcggtaaaaaaggcagtgggatgatttgtttaaatggtgctgctgcaagatgcgtaaatactggcgataaggttattattatggcctatggaaattacgatccaatagaagcaaaatcacataaacctgcagttgtctttgtggatgaggagaataaaattagccgagtaactaattatgaaaaacacggcttattaaaagatatgaaataatcagcagtgatgtcagttaagggtactatctctaaatccataagaaagaagagaataaaatgcagataacaaaaacagtagaacaaacaagaaaactcattaaagcatggaaaaaagaaggaaaaacgattggtcttgtaccaacgatgggttttttacatgaaggtcatgcaagtttgattaaaaaatgtcgggaagaaaatgatattgttgtggtttcagattttgttaatccaacgcaatttggacctaacgaagatttagaagcatatccccgagattttaaacgtgatagtgagttgtgtgaaagcctgaaagcagatttgatttttaatcctgatccagaaaatatgtattgtgacccccagtcatatgtaaatatcgatttactttcaatgaccctttgtggtaaatcaagaccagttcattttaaaggtgtttgtacggtagtagcaaaattatttaatattattacccctgatagagcatattttggtcaaaaagatgctcagcaattagcaatcattcgaaaaatggtacaggatttaaattttgatattgaaatcattggctgtccaatcgttcgtgaaagcgatggtcttgctaaatcatcacgaaacacgtatcttaattgcgaagaaagaaaagcggcactttgtttatcaaaagctgttaaagaaggacaaaatgtcatttttcaaggatgtttggccagtgatgtaataaaagctatgcaaaaggttattgaaagtcaaccgcttgctaaaattgattatatttcagtagtggatgccctaacgatgcagccagtaaaaaaagttgatcgaaatgttcttattgcaatggctgtttacattggtaaaacgcgattgatcgataatttttcatatgaggtgtaatcaatgaaaaagatcataaaaatcagttcattattaactaaatatattggcattataatcattattttttccggattagcctttttaatacctcagggttttgcctggacaaccgattatacttctgtttttttaggagttgcaatgtttggaatgggacttgcaataaaaatgggagattttcaaattgttttttcacaccctaaagaagttattatcggctgtgtagctcagtatacgatcatgcccttagccgcatggttattagcagttatctttcaattacctgaagacttggcaataggtgttatcctggtaggctgctgtcctggtggaacggctagtaatgtgataacttatattgctggtggtgatgtcgcactttcagtaggaatgacgatcatatcaactttaattgcgccactgatgacgccattattggtttatgttttagccggtacatgggtaaaagttactttttggtcaatggttttatcggtagtaaaagttattttgattcctgttttactgggaattttgattcgcagtttatttggaaaacagattcaaaaaatttctgatatattaccgcttgtttcggttgtatcgattgtaatgatcatctctggaattgttgcaattaatacagaaaaaatcatagcctgtggtattttagtactatgtgtagttatcctccataatttattagggatgatgcttggtttagtagcagcaaaagttttgcatgttgaatactctaaagcgacagcaattgcaattgaagtaggaatgcaaaacagtggtctagcggtttcattagcaaccgtaaattttgcagctaatccacttgctactttaccaggagctatctttagtgtatggcataatatttctggttcgatttttgcaagtattagacagtcatctttaaacaaagatgaaagattagaattaaaatataaaactaattaaaaagaagaggcagctcttctttttttagtcctaaaaattaaatctgctttgagaataaattcattcatgttaaaattaattaaaagaaatattatgatttgtaaaggagagcaaagatgaaagaagaatgtttgatttgtaaagcgccgttagaatatcttgagaccgatacgttgatggaatgtattctttgccaccgtcaggagtatagtaaaacacgctgtattaatggacattatgtatgcgaaaagtgtcatatgcagggaattgataatatcattcaagtttgtttaaatgaaacttcacttgatccaattatgataatggaaaaattaatggatttgagtttttgtcatatgcatggtccagaacatcatataatggtaggctcagctttgttgacggcttataaaaacgctggtggcaatctagatctaaaaagtgctttaatagaaatgcaaaatcgaggtaaaaagattcctgggggaatttgcggtttttggggtgcttgtggagccggaataagcagtgggatgtttattgcgattgttactaaatcaaccccactttctaacattgaatggcgactttcaaatcaaatgacagcggcttcattaaaccaaatcgggaagcatggcgggccgcgatgttgtaaacgagattcatatcttgcaattttagcagcaatcaaatttgttaaggaacacttaaatattgaaatggaaagcagtcagatcgtttgtaagcgttccacgatgaataatcagtgtattcaaaaaaagtgtccattttttaaaatgaatcagaagattagtttggcggtggattagatgaatttaaggttagctgtgatgtcagatttatcacaaattattgaaatgtataaaaaaattatcgctaaaatgaatgataatggtattcatatttgggatgagatctatccttgtaaatattttaaaaatgatattgaaaataatcagctttatttattatgggacgatgataagattatttcagcatttgttttatgtgatttaaatagtaattccaaaagtgtaaattggtcagataaaaatgctaaagcattatatattgaacgtttaggggtaaatgtcgattatttaagaaggggaatgggtcttcttactattaataaagcaatggctcttgcaaaggaaatgaacggtgagtatttaagattatttgtcgtggataataataaggcggcgataaatctttatcaaaaggccggcttgaaaagagctgctggaatttatgaagaagctattgatgataatttgactctgtatgaattaggttttgagataaaaatatcttgattaaaaaaagatttcagatcttgaaatcttttttatttgaaaataagaaatattttttcgaaaatccacaataactgctttaatcaggttgttgccctgtatgggcagaccactgacattttgtaatttgcatttgtgaaaatacggctttaaacgaagaattttcaggagaacaggcataaataccaaaagcaattttattagcgcctttgaacatgtgacagattctcatttgggtgaaagtaactccatcataagagcattcgatacaataatcatcttctcttctgcttaaacgataccacatcgatttgatcgaagcatcgattgctgtagtagcccaatctgagtaaccgtgatttgttacaacactgcctaaatgctgatagtcatcattttcatattctatagaaccctttaaccagttttcactatctaaatacatgacaatgccacattgatcaaaccgatgatgactttctttaaaatctgtttttacaataaaactaaaatatttctcttctgtttctatttgtaaaacgggcgcattatcattttgaaaatgataatatgttctttgccatagatcagtatatggttttgtaacaatttcaattcgatcatcatatattttgtaactttctggttttcgtgtccatttaaatttttttaaatccatttttattagtctcctttttcaattaaaaatcactgtctttattttataagaccacattttttatataactcagatatgcaatctgatttatattctaaatatttttcaatattatcaggaaataatcttgcgccctctttttttacctgactataaagtttgatagcctcagggtggctttttaaataatctctaaaagtgatatgtctttgcagctcctttgaatttttaggacatacatataaatgatgcgtttgtaaatgttcttttcccgtatatttaaaagcttctctgtctggaattcctaagttgccttcatgtatatagccaatctgatttaatttttcgattactttatttaaatcagatgttgaggcaatcacgatatcaatatcgataattggctttgccgttaatccttcaacagctgtactaccaacatgttctattgataaagctaagttttttaaagcttggtcaagttcattttttattttcaaaaaatcatttttccaattaatatcatagtcaagtacagtaacttttgttgttttcataaagcctccttcagtttataaaaaatgtttttcaaccatgtttaatagtatcaacacagtaaaaataagaaataattctataatgctattaatcgtgccaaacataataataaacatacttaatatcaacaatgagcgatgaaataaaatatttgttttttgataaaattcagaatctattagcatgattcgattaattaataattgaagtattactaatagtaataaagccccaaaagatgacagaataatatgtaacattgaaataatattttcattatcaggatgataaggcaaaaaagaaccaattattactgataaaaaactaaatattatcaatgttttgtttaaaggggataaataagtaatttttttaaataatttatttattttgtatagtaaaaaacaagaaatgatcatgatccaaagtagataatgaattcgcagatccttttgatatgacaagtaagtaaaattattatatgtccaggaagtttttaatgatagtaaaaacgtgtaaatgagcattagatagtacatttttgacctccattgaggttattttaataaaatcgaaaaaaaatgtaaataataaaagaaaaatccttttttttgaagtaaagaataatgaggaggaattttaaatgaaaattgaattaagaagtattcatggaaatgttgttaatgacaaaaaggctcgagtatctaaagatattaaggctcatattgaaataggctatagccatagtcaaagaggaaatctaagccttaattatcaaatcaaggtaggtgagaaaaaagaacagctttttgtcgttaaatgtgtttttgaaattcaaaattatgatcgtaatgtagatgaaaaaataattcttgatcgagctgttgatttacttcaagagcggattgaagttattcttggactaattagtgaagagatgggaattgatctacagggttgaagaaattcatcaaccctgtaacaaacttgaattattttcatattttataatagaggtggaatatgttagtctatattaatggaactgataatcggtgtaaatatttagctaagctgatggctaaagctggttatcaaatagaaaatgataaaaattatatatcatcttgtcaaatcgtatttttgggaaaagatggtaaaagttttgaacaagtagattttgcttgtgatgccgttgttttgacattgttaaaaaatcagcgattatgttatttaagtaaactaaaaggttttaagtatgattatttatatcatgatgaagaatttattaacgaaaatacttatattagtgatgaagcattaattgcttatatgatcattgataataatattagtctttcaaattcaaatatcttaatattaggttatggtcattgtggcaaagatctagctaataaattagaacgatttaatgctaagatcacgatttctaatcgcagtgatcaccatcatgatgaagtaattactaagggatatcgttatatacgtttaaatgagcttacattagatggatatgattttattatcaatactattccatgtaatgtaattactgaagaaatgttaaagacgaaagccgatatgtgccaaatttatgatgttgcttcaaagccgtatggattacaaagtgataaacgtgatactaattatcatttgttgaaacaattaccaaccaaatatgcatatcatagcagtgctttagctttatttaaagcaattaaaagggcggttgatcgtaatgttaaaaaataaaaaaattggggttggaattactggttctttttgttctttaaaaaaaacaataaccgttttagatgaattagcaaaacaagactgtgatctatatgtatttgtcagtgaaaaaatattaacttgtgatactcgttttggtgaagctgatgaactgattgcaaagattgaaaaaatagcaaaacgtaaagttattacggatgtagtaaatgcggaaatttttggtcctaaaattcctttagacttgatgctggtcatgccttgtagcggcaatacattagcaaagcttgtttatggaatcaatgataatgcggtaacgatggcttgtaaatcaactttacgtaatgaacataatgttgttttagcaattgcaacaaatgatgctctaagtaattcaggaaaaaatattatgcagattttaaatactaaacatttttatttagttccaatgtatcaagatgattgtataaaaaaaccaaatagtatgttatttgacgaaaatttagtactccagactttgatcaatgcattgaataataaacaagtacaacctgtatttgaaggtaataaagatgtatagagtcctaaaatttgggggtacatctttacgtgataaaaaaacaattgattcagtaattgaaataataaaaaaacatttagatcataaattagtaatagttgtaagtgcgatggggcgctatcccgatccttatgctacggatactttaaaagagttagtttcctggcaattatcttttgatgaatatagtcggatcgtcagttgtggcgaaacgatcagcagcgttgttttatcaagtgaattaaagaaacaagatataaaagctatttcactttcatctttacaagctggtttaaaagttaaagggcatcgttttgttgattttaataagaaaaaagtaacggaatatttagaaaaatatgatgttgtcataattcccgggtttcaaggagtagataaatttaaaaatgttcgtattttagaaaaaggcgacagtgattatagtgctgtttatattgcgcgaagaatgaatttagatgaagtttatatatatagcgatgtttgcggtatatatacaggagatcctaaatatatcaatggagctcgtttaattaaacatgtagggtatcgccaggcattggatctagcgaaacataaagctcggataatctgttataaagctcttttagaggggtataaaaaagatggcttcaaaattaatttacgttctatttataatgggaatattggtactttaattaatcatgatgatactaaaataaaaacgatgtcaattgattttaattattggctgattcgttttgatgaagaaatcagcaaaaaagattttaattatttatatgataaatatgaaaatgattatcttattttagaagaagatcttcataaattgacgagcagatatacaaaaatcgacgcttatacaaaagttcattttgttggttgtgaattagaaaatgatgatatttatcgaaactttttagaaaaatttgcgcttacttctactaaagaagtagatagttattatgttaaggtcaagatgcaaaaacaagatcttaatttattgcatgatttaattgttttaagtgattaaaagtgtagttttattaatttgaaatcataaaaataaaatgttggaaggaggtattgatgtacatcgttctaacattttttaattataatagatgaaagatcttatataagttccaataatttctagtaatattacaaagaaacggcttaagatcagggttttgcgaatccttgatccaaattaattatgttatcaaatttcaataaattattaaagattaggatttgaatacataaagatggtatttaatcctgatatagaagttaatttaagttctccatacaaacaaatcggtaactgcctgttgtttttgaatcttctatcaggttcacctgatttgtttacatatttccaagtttgagcaacgacttgggaatcttttggtattccattactttcaataaaacgtgttgtataagttgaaaaagcaatatcagaatagtttaatacatcgattttgttgccttgaattaaaaataatttatcaggtaaaaataataacgtttcttttcctgctttgaatgatgcgatttgcagattcgttttaaatggaaaaggtgctttcgtgctggctttgcaagttgttcgattaacggtattgcttgcaccagaagtatattttttattaataactttacttgtctgcataattctccaaacttttgcagactcagtaatcttaatcataggtttaattctttcatcaactaaagattgctgatcagtgtcaatattgtactctaaattaatggtacctttgattttaacaaaaattttaagaattaagaaaaatattgaaaataaaaataaaattggaaaaccaaaacttaaaatcaaagagatccaaaagccaatattagccagcttgtttaatctcaatgctttgctggcaaatttacacatagttcttaattcctcagaaactatttcagatgcaacaacatttacgatatttcgtgtatcataatgattgttatcaattgatggtaaaggttgttgtgaatcaggtgtagtatcataccttgaattatttatattatttttgtctgcttcataaacatatgatgtatctgttgcaattttggtaaagcgatgatcatttatattccaactatagccaattcctgatttatttaagttgattttaaaacaaccacctaagttgataatttttctatatcgaaatcccattttttgcttctcctttataatctgaatcatattcctcagatatattttcatgttcctttcccacttttttctatttatagaatagcaaagccagttatcttcgtcaattgttaaaaatggcggatttaatttgttatttataagtataatggctttgattatatgatagataaaatagaaaaagtaattttttataaaatatttctttatatttgtttatcttctatttcctttgctatttttaaatcattatatgtatgagagaaaaatatcgctattttttagtataaataaatttaatgggtataattttattaaaagtattgaaaagagtcagtaattttatttttctttttctttaaattttgttacaatatttttagaaagtattagccaagtgcattatgttgtggtaatatattagagattgttttttacacatgcttgaaataataaaataataaaggaggaaaaaatgagaaaagatattgtaaagattttacctcttggcggacaagctgaaatgggtaaaagtatgtactgtattgaaataaaagacaaaatttttattttagatgctggctttaggtttccagaaatcaataaattaggagtagatatcatcattcctagttttgattatttaaaagaaaatgaagaacgaatcgtagcaatcattgttactcatggacatgatgatgtaatggcggcgttaccatatttattagagagtgtcaatgttcctgtatatgcaccaactttaactgctgatttgattgatcaaatgatgaaacgtcataaaaaacataataatttaaaacttaattatcagcttataaaagttaaacgtaatgattcaattaatattgcaggagtaccagtagaatttttccctgttactcattctattcctggaagtgttggtgtcgcattgtggacaagagatggttatatcgtctatagtggtgagtttatcattgattttggtgctccagaaggttttagatgtgatattcaaaaaatgatggaaattggcaaaaaaggtgttttagtattgttgtgtgaatcatcatattctaaaaatactggctatacttctccaaaacataaattaactgaaaaaattgataatatctttgaagatagcgaaggacggatcattatttcatcctatgctcaaaacatttttagaacaaaagaaatcgttgaattaacaaaaaaatataaacgtaagatcgttttttatggtcgtgataagtacgatagtacaaacagtatcgtaaggatcgggcagcatttgaaaaaagctgtaatcaaagtacctaaagagataattggattttctactgatattggtaaaaaaggcattgatgataatttagtaattttgctaagtggtaagccgcagcgtatatatcatgatattagtgatatcattgatggtggtgatgagtatttaaaacttaatgaaaatgatacttttatcgtagcatctccagtaattccaggaactgaaaagattgccaataaagcaatcaatgaattgtataaaacagaatctaaaattcatgttttaaaaaataaagagttattttcaatgcatgcttctcaagaagatattaaagtaattattcaaattttcgatcctacttattttgttccaattaaaggtgaatatcagcatttcatttctaatatggaagtagctaagagtatgggaattgatgcgaaaaatattccgttgatcgataacggtgaattcttgagtttcaaaaatggaaaattagaagattatcgtgatacaattgaagtcgaggatgtaatgatcgatggaatcggtgttggtgatgttggtgataaagttattgatgatcgaattcagctttcaaatgatggtgtagttattattggtgtaactattgatagtaatagtcgtgaaattatcgctaatactgatgtccagtcacggggatttgtctatttgagagattctgagcatattattaaaggaattgcggatattgctgaaaaatgtgttgaacaaatgaaaaatgatcctaatttagaagcaatcgaagtccgtcaggaaatcaaagaaaagtctaataaatttattgttaaagaaaccggtaaaaaaccagttgttttaccaattattatcgaaatttaagcaagtctaacttgcttttttctttggctaaaacagatggttatgttataatggttgagttagagtagggagtgtgagtcatggctaaaacaagtcgttcaaaaaaatctaaacaagaacaacttagtgaagatttaaaagttagaatcattgctgctgtaggattgtttttaacgatcgttgcaacgttaaagctagggttaataggagtgcagctaaattttttatgtacatacatattaggtaattttgtaggaattggttatgtggcattgatcctagttagtatatatgtaatttatcacgcgaaattacctcgttttaatggtcctaacgccattggtttctacttgttatcgggagcagttttaacatttatgtcttcacttagtgataataatatgaccggaatgaaagttattgaccaatatattcaacaagccccatgtaaccgtggtggttttatcggagccttattatacggattattaagtgctttgtttgataaaacaggagcaatcatcgcctctggctttgtcttagtgatttctttggcattattgggaagtaaattttatcttgaacagcgaaaaaagaaacaaacaacttctaaaaagaagaaaaacaaagaaaaaacacaaagcaaatttattgatttctttactaaaaaaagagatattgctttttttcctgatgacatatttgaaatagatgacaaaaaaccagaaaagaaaacatcagcacggatccatacagctcatctagaagaagatgacagcattccttcagctatggaatttgatgaaaaatcaatgactttagaaatcaaagaaaaagaacctaagatacatgataatgacagtttaaaaacaaagcagaaaatcaataaaaattatcgtctaccagcattatcactattaaaaaatccaacttccaaaaaatccggtgataataaagataatgctttaaaaaaagccgaagccttgactaatgttcttcatgaatttggtgttaatgcttccattagcgatatttttatcgggccatctgttactaaatacgaattaaagctcgaaacgggaatcagagtcaataaaatcattcagttacaagatgatataaaattagctttagcggcaaaagatattcgtattgaagctccaattcccggtaaaccagcagttggggtagaaattcctaacagcgttgcaactacagttacttttaaagaggttattaaagatattcctaaagaactacaggcaaataagcttttggttcctttaggaaaagacgttagtggaaaaacgatttatgctcaattaaataaaatgccgcatttactgattgctggagcaaccggaagtggtaaatctgtttgtatcaatacaattatttgcagtattttaatgcgggccagacccgatgaagttaaatttattttggtcgatcctaaaaaagtagaattagctaattataatgggattccgcatctattagctccggtcgtgaccgatcctaaaaaagcagctgcggttttacaagaagtagttgtagaaatggaacgacgttatgatttgtttgctgaagctaatgttagaaatattgaaggctataacagctatatccataaaaagaatgagactttagctttagatgaacagttagaatttttaccatttcatgttattattttagatgaggtagctgatttaatgatggttgccagtaaacaagttgaagactgtatcatgcgaatagcccaaatggctagagctgcgggaattcatttgatcgtagctacccaaagaccttcaactgatatcattacgggagttattaaagccaatattccttcaagaattgcttttgcagtatcatcaggaatcgattcacgaactattttagatacctcaggggctgaaaaactgcttggtaaaggcgatatgctcttttctccaatgggttcaagttcaccagttcgggttcaaggtgcgtttgtatctgatgaagaagttaatgcgataactcatcatacagccagccagcaggaagctaattatgatgaaaaatatattaatgttaaattgaacaccacttcgatgagtgcagcttcaaaagaagaagaggaagatgaagaatacgaaatgtgtcgcagttttgttatcagtgttcaaaaggctagtacttcattgttgcaaagacaatttagaattggttataataaagcagctcgaatcattgatcaattagaagctgatggtgtaattgggcctcaaatcggctcaaaacctcgtgaagtatatattcgcggttatcaagaagaagatgtctaagcagacatcttttttgatcttggaaaataattatgagtagtattttatcaagaaaatatggttttaattttatttttcaatttttagtgtataatatagacattagatttaaagaaggagtgtcatatgaaaaaaagttatcagttatcaggatatacattgcatgtaattccgacaaagaaatttaagaatataacgatgtctttaaaattagaaaataaattgactaaagaaaatgtcacaaaaagatcattattggcatttatgttaactggtggaactgaagaatatccatcaacacaagctttatctacccatttagaagatctttatgggatgaactttggaactaatttagcgactaaaggattatcacaagtattaaatatttccagtgtttgtatcaatgaggcttttttaccttatcaagaagatttattaaaacagcaaatcaagttatttaatgatgtcctttatcatcctaatgttttgaatggtaaatttgatgagcagacttttaatatcaagaaaaaagagcttaaagagcgtttgatcgttcaaaatgatgataaatttatgtatggtctaaatcagttatttgtaaatatgggtgaagggggatttttatcaatcagcaataatggttatattgaagaacttgataaaatctctaatgaagaattgtatcagtatttattagactgtataaaaaatgatgtaaaacatttatatgttgttggtgatgttgatgaaagtattgttgaaatatgcaaagaaaatttaagttttgatcctgcaccacatttaaatgaagtggtaacaaattttaaatcgacaaaaaaagaagttcttgaagtaattgaaagacaggatgtaacgcaggcaaaattaaatcttggttttgtagtagattgtaattttttagatgaaagtacttatgccatgacggtttttaatgctatttttggtggcttttcgcaatcaagattatttaaagtagtcagagaaaagcatagtctttgttattatatttcctctagttatggtgcttttagtggcatcatgacagttaatgccggaattgagggaagtaattatgaaaaggctaaacagttaattattgaagaactagctaagattcaaaatggtgatcttagtgacgatgaaatagctttagctaagttaatgttaaaaagttcccttataaaaacaaaagatgaaccaatgagtttaattgctttagcttataatcgtgatttaactaacaaacaagaaacagatgatgagtatcttgaaaatattttaaatgttactaaagaagaaattattgctgcaagtaaaaaggttcatttagatacgattttcttgcttacagggagtgataaataatggaaaaaatatattttgaaactttaaaagaaaccttatatcacgaaaagatggataatggcttagaagtttatttactgccaaaaccaggttttgaaaaaacatacggtttattttcaactagatttggggcaatcgatacgcggtttgtaccaatcggtcaagaacaaatgatcaaagttgaagatgggatcgctcactttcttgaacataagatgtttgatatgaatggtagtgatgcttctgatgaatttgctaaattaggagcaagtactaatgcttttacttcttcaagtcgaactgcttatttatttagtaccacagctaatgaatatccgtgtattgaattattattggactttgttcaaaaattagaaattacaccagaaagtgttgaaaaagaaaaaggaatcattggtcaagaaattaaaatgtatgatgatgatcctgactggagagtttatttcggatcgattcaaaatctctacaacaatcatcccgttgcagtcgatattgctggaacagtagaaaccgttaataatactactaaagatatgttagaaatctgttacaatactttctatcatccaagtaacatgatgatctttatcgttggtaatattgaagctgataaagcgatgacagtaattaaagaaaatcaggctaagaaaaattttgcaccagcgaaacctattgtttgtcaaaaaaatattgagccatgcaatatcaagatcaaagaaaatgttttaacgatggatgttgaaatgaataaaataatcgtttcaattaaagtaaacgaaatcttgaatgatcctaaattaaaaatcagacgagaattagcaatcaatcttttattcgatttattattttcaaaaagtgctaaattatataatgactggttaaatgaaggaattatcaatgattcatttagtgctaattttacccaagaacgtgattatgcatttattcaaataggttgtgactgtgatgattatgagacattaaaggatcatatacttactttgattcaaaatttccaaaatatcgaaatttcaaaaaatgattttgaaagaatcaaaaagaaaaatattggtttgttcattaatttattcaatggacctgaaagcattgctaatttatttagccgttattattttgaaggaataattgcgttagatttaatcgatgagattgctaaaatcactcttgatgatatttatgatatgtttaaatattttgacagtgaatatactagtgtatgtattgttaaaaaaaagtaaaatatgttaaataacaggtattaataatagttgacacttgtcatgcttatgttataataactttggttagagagtaaataaatttccacatcatagataagggagcctgatttaaattgcggtgttgaaaacctatcttagaatagggatcctaaagtgtatttaaaggtgcccacctgtacaaaacagggaaatatctaaaactctctacctttttttatacaaggagaaaggcaatgagtagtatagatcaaaaattaattactagaattaatgaactggcaaaaaagaaaaaagatggcagtatcactccagctgagttgaaagaacaagaaaaattacgtcaggagtatttaaaagcttttagaagtggttttaaacagcagttaatgacaatcaaagtagttgatacaaaaggaaatgatgtaactccaaaaaaattaaaagatgaaaaatcaaaaaattaaagatatttttagaaacttattcaattttagacatttttgtgtataataaggataagttttttatgtgtaaaaggagaattagaaataaatggaaacatcgaatttatcaattgcagcaattcgtgctttaggcattgatgctatcaacaaagctaattcaggacatcctggaatggttttaggatcagcacctgctgtgtatacgttatttactaaagaaatgaatttttaccataagcaggcaaaatggtttaatcgtgatcgatttgttttagcttcaggtcatgcttcagcattgttatatacaatgttacatctatcaggatatcagatctcaatggatgatttaaaaaactttagacaatggggttcaataacaccaggacatcctgaatgcaatcttactgatggtgtagatgcttcatctggtcctttaggacaaggaattccaatggctgctggaatggccttagcagaaaagtttttagcagctaaatataatcgtgatggttatgatattgttgatcattatacatttgcattatgtggtgatggtgatatgcaagaaggggtaacttatgaagccgcttcacttgctggacatctttcacttggaaaattaattgttttatatgatgctaatcaagttactcttgatggtcctttatcaatgtcgtttagtgaagatgtaaaaaaacgttatgaagcaattggatggcaggtaatcaatgttaaagatggtaataatattaatgatattcaaaaagcaatccgtaaaggtaaaaaggaattgtataaacctactttgatcattgttaatactgttattggttatggatcaagtaatcagggaacaaacaaggtacatggtagtcctttaggcaaagaagatggtagaaatgctaaattatcttatggatttgatcatgaggaattttatgttcctgaagaagtttatgacgattttgcaaatagttgtattaaacgtggtaaaaatcgttataataaatggcagcgtttatttaaaaattatgaaaaagaatttcctgaattagctcaagaattaaaagatgcaattgatggaaaatacagtttagatattgaagaaatcatccaaaattacaaacctggtttcaatgatgcaacaagaaatacttcattacaattaattcaggaagcagctaaacaaaatcctacatttatgtcaggaactgctgatttagcttgttcaacaaaaacggaaatcgctaatgaaaatgcttttagcgttgaaaattatgatgggcgtaatttagtttttggaattcgtgaatttgctatggttgccatgatgaatggaattaccttacatacaggaatcaaagtatcagcaggtggtttcttagttttctctgattattttaaagcagcattaagaatgtcttgtttaatggaattgccaatcataattcctttatcacatgattcaattgctgtaggagaagatggaccgacacaccagccaatcgagcagttagtaatgcttcgttctttaccaaacattcgggtattaagacctgcagatgcaatcgaaacagctgcggcttggaaattagcaatcgaatctactaataaaccaacagcattgattctaactagacaaaatgtaacgacaatggaaaatacttcatatgaaggagtaagcaggggtgcttatatcgttggtaaagaagtcgatcatcttgatgcaataattatcgctactggtagtgaagtaaatctagcaatgaaagctaaagcagctttattagaagaaaatatcgatgttcgggtagtttcgatgccatcgatggaattgtttgaagaacaagataaagcatataaagaatcgatccttcctaatgatgtaagagctcgtttagcaatcgaaatggctagtgattttggctggcataaatatgttggattagatggtaaaacaatgtcagtaagtaaatttggagctagtgcaccagctaatgtagtaattgaaaactatggtttcacagtggaaaatgttattaaaaatattaaagaaatcttataaagagttgttttgatacaactctttttattgttcaagctgtaaactagattctttggataaactgctttcgatattaaattaaaaataatatattttgtttttaaacattttttgacaatttttatcatttgatcttgctaagattattacggtgatagaaatgaatacatataaaatatatagattaaatcctaatgtaagggagctttttgaacaatatccggaaataaaagaaaaaattattaaattggaacccaaaaatgtttttttaactaagcagatggaatgcttctttggtaataacgagggagtaagtgattatattgaacatcgcttaaaagaacgttacgattatttaagagataataatattcatattattgataatcagttgacaaaagaaaaaatagtttgtaaagtttttgattattatgtaattattgaggcggctaaaaaaagcaatatattctttgagattttatatcaaatttcaaaaagttatgttataattagtgagcaagtaaaaaaattggaggtatgaacatgatcttaaatatgattattggggtaattatcggcgctattattggtttctttggggctcgttatatgtttaaaaaacaattacaaaaaaatccaccaatcaatgaaaaaatgattcgtgcaatgtatatggaaatgggacgcaaacctagcgaagtacaaataaaaaaaattatgtcatctattatggcacaatataaataaggggaagacccttatttttactttatgaaattattcattactagacattcaaagacattgtggaatcaagaaaaaagacttcagggctggaaagattcacctttaacaaaacaaggcatcaaagatgccttgctattaaaagaacgtatcaaaacattaccgatcgattattgttatagtagtccgatcaatcgtgctaaacaaacaagtgagattttatttgatcatattattctagatgatcgtttaaaagagatgaattttggtatttatgaaggaagaaaaatagcagaattagtaaatgataagcagtatgatgatttatggaatcatcctgatgatcaaattagattaacaaatggtgaatcatatcttgaggttcaatcaagattaaaagattttattgcggatatttatcaaaaacatcatgataaaaatatttttattacgattcatggaatgttatttattattttacatggcttgatgcttaactataaaatcagtgatctaactaagatcaatcagcatgtcgtgcgtggttgttcgcttagtgaagtggattatgatggtaaaaattttacgatcaaatatattggcgatgctagtcatttagaagatgaagaaattattagttataaataaaatcagtcattttgactgattttattacatccagcttattttactttctgttccttgcttaactctttttaaattctcacgatgtcggtaaatcaacaataaaataattgccgcagtagctaatttaccagttagcgaaatatccaaaaaaggagttgctagtaaaactgatgaagaagctaaaactgatgaaagcgatacatatttactgatttttaaaacgataaagaaaactactagggctaaaacagctcccaaaggattaacagcaaaaaaatatccaattgctgtcgatacagcttttccccctttgaaatttgcgaagattggataacaatgaccaataacacaaaacagagcacatagataagataaatctttatttaaagaaaattctgagcaaaaatatttagtcaaaagcattactaataaagcttttgaagcatcgagaacaattactgcaaaacccgctttttttcctaaaactcgaccagtatttgtgccacctaaattaccagaaccgtagtttctaacatctgttttataaaaaagtcttccaattactaatgcaaatggaatcgacccataaagatatgcgagaattattaaaattactgaaatcatatttatcaccttcatttattatatattattagtttaaaaaagcaatcatttattctaaaactttaactaattaaagggaattgtgatagaatattaaatgattattttttcataacttgttaaaaatacaataacctttgaaaaatacagataatttggttataatgacaaaagtgattaaaggaggcaattgattaatgacagctaaaagtaattatgatgaatcaaatatccaaattcttgaaggattagaagcagttagaaaaagaccagggatgtacatcggttcaactgatagtcgtggtttacatcatttggtttgggaaattgtcgataatgctatcgatgaagctcttagcggatttggtgataacattcaagtaacgatccatagtgataatagtattgaagttagtgatcatggtcgaggaatgccaactgggatgcatgcttcaggaagaccagcgactgaagttattttgacagttctccatgctgggggaaaatttagtgaagatggaggatataaaacatcagggggcttgcatggtgtcggagcctctgtcgttaacgctttatcatcatggttagaagtaacgatttatcgtgatggaaaaatctggtatcaaaaatttgaagacggtggcaataagatcagcaagttaaaagtgattggtaaaactaataaaaccgggactacaattcattttttaccagatccggatattttttctgtgtgcgaatataattattctacgatcagtgaaagattgatggaaagtgcctttctattaaaaggaatcaagattgatttaaaagatgaacggaataataaagaagtgtcttatcaatatgataatggtttgactgcttttgttgaatatttaaattatgaaaaagaaactcttaatcccatcattaacattgaaggatctttaaatgaaatcgaagtagatgtggctttacaatttacaagcggttatcaagaaaatacactgtcatttgttaacttggttagaactggtgatggtggaactcatgaaacgggattcaaagctgctttaacgcgaacttttaatgaatatgcccgtaaatacggtttgttaaaagaaaaggaaaaaaatctagaaggtaatgatgttcgtgaaggattatcggcaataatttcaatcaaagtgccggaacattttttacagtttgaagggcagacaaaatctaaattaggaacaccagaagcgcgaaatgtcgttgataatatcgtttatgaaaaactatcattttatttagaagaaaacaaagaaacagctgatgttttaactaaaaaaatgattaaagcagcccaggttcgcgatgccgctcgaaaagctcgcgaggcagctcgaaaaggtaaaggggcaaaacaagaaaaaattttaagtggcaaactagctccggcacagtcaaaagataaaaaaagaaaagaactttatttggtcgaaggagattctgctgggggaagtgctaaacaaggacgtgatcgtaaatatcaggccatcttaccacttcgtggaaaagttgtgaatacagaaaaagcagcgatgagtgagattttaaaaaatgaagaaattgcaactatcattaatactataggcgctggtgttggtcccgattttaatgaaaaagacagtaactatagtaaagtcattatcatgaccgatgctgatactgatggagcccatattcaaattcttttattaacttttttctatcgctatatgcgcgatttaattacagctggaaaagtatacatcgccttaccgccattatataaagtttctaagaaaaatggaaaaaaagaggaggctatctatgcttgggaagatgatgaactagaagaagctaagaaaaaaatcgggcgtggatataatgttcagcgttataaaggtttaggagaaatgaatgccagtcagttatgggaaacaacgatgaatccagaaacaagaactttaattcaagtatccatcgatgatgctgcgattgtagaacgacgagtttccgttttaatgggtgataaggttgaaccacggcgtgaatggatcgaacaaaatgttcagtttacattagaagataattttgcaattgattaaggagaaatttgatatggataaaaaaatagtcatgtcattagaaaccattatgggtgaccgttttggaaaatattcaaaatatatcattcaagatcgtgccttacctgatgttcgtgatggtttaaaaccagtacagcggagaattctttattcgatgtacaaagaaggaaatctatataccaagccatatcgtaaatcagctaagacagttggtaatgtcattggtaattatcatcctcacggtgatacttctgtttatgatgcaatggtccgtttatcacaagaatggaaaatgcgagcaccattagttgatatgcagggaaacaatggttcaattgataatgacccagctgcagcgatgcgttatactgaagcgaggctttcagcaattgctgctgaattattaaaagatttagataaagaaactgtgttgatgtcattaaactttgatgacactgaatacgaaccaacagttttgccagcagcatatccaaacctgctggtaaatggagcgacgggtatttcagccggttatgctactgatattcccccgcataatttagaagaagtgatcgaggcgacgattcaccgcattaaatatcctaactgttcgttggagaaaatcatggaatttgttaaaggtcccgattttcctactggagcgatcgtagagggtaaacaaggaattttaaatgcctttaaaaccggtcgaggaaaagtcattgttcgtagtaaaactacaatacttgaagaaaaaactatgaataagatcgtggttacggaaatcccttatgaagtgaataaagctgaattggtaagaaaaatagatgaaattcgttttaatcgcagtattgatggtattattgaagttcgtgatgaatctgatcgtaatggacttagaatcgtaattgatctaaaaaaagatatttcagtacaaaatacattaaattatttatataaaaatactgatctacagaagaattataattataatatggtagccatcagggataaacggcccgtgttaatgggaattatggatattttagatggatatattgatcatcaaattgatgttgttaccagaagttcaatttatgatttaaacaaagctaaggcgcgaaagcatatcgttagcggcttaattaaagcaatatctattttagatgatgtcgtgaagacaatcagacaatctaaagataaaggtgatgctaaaaataatttgatcattaagtttgattttagtgaaaagcaggctgaagcaatcgtaatgttacaattgtatcgtttaactaatactgatattgttacattggaaaatgaaaataaggaattagatgaaaaaattgcttatttaaataatattttagatagcgatgatgttttacgtaaagtaattattgatcaattaaaaacgatcaagaaaaagtatcctatgccaagattatcaatgatccgtgatgagattcaagaaattaaaattgatgaaaaggcaatgatcttatctgaagacgttaatatttcaattactagagacggttatatcaaacgaatcagtaagcgttcaatcaaagctagaggaacaacgccttttggtaaaaaagaaaatgattatcttgtctctatgtatcaggctaacacgctggatcatttattgttatttacagacgctggtaattatttatttgttccggttcataaaattgaagagtttaaatggaaagatgccggtaaacatattagttatttgatcaaagttagttcaagtgaaaaaattattggaactattttagtaaaagattttaatctgcctttatatgtaatgctggctacaaaaaatggtcaaataaaacgaactttattaaaagattttaaagttacccgtttttcaaaaccgcttaaatgtatgggacttaaaaatgatgataaagtaatcgatgttaaattaacagataacaatcaaggtattattttaactactaaagcaggttatggagctctatattcagaacaggaagtatccgtggtgggaataaaagctgctggtatcaaagctatcaatttaaaaaatgatgaattaataagtttaaatatttttgatccaatgacaagctgttcattaatggtgattagtgaaaatggtggcataaaacgaatcaaaattggtgatattacaccatgtaatcgagcaaccaagggaacgttattgtataaaaatcctaaaagcaaagtcatttatgtcaaaaaagctgttgttatcaataatcaacagcaaataactttaacattaaatgatcaaactaattttacatttaaagcatctgattatcacaatgcttcccttgaacaaaaaccaactgtatttactaagttgacagataatcaatttattgatgatgtttatttagacacaccaatttctactgatgattatcatgatctaaaatcaaaggatgttgcaccagatattttcaaacagcctaaagagcatactttattagacgaacttgatgaaccagttatagaaaataaaataactaaaaagaaaaattcatcagtaaaaaaatctaaacctgtaaaatacgaaaaaataagtttagaagatatattaaatgaagatgaattttaaaccgtaaaattattttacggtttttccttcatgtgttcttttaacaattttattaatgctcttttttccagccgtgagacataagaacgtgatatatttaactttttagcaatttctttttgggtatgttttttagtattatttaaaccataacgcatgatcaacgtttctttttctcgtggttctaggattttaaaataattagcaaatttatttaaagtatcttttttatcaacgatatcaataaattcttcctgcttagcggcaataatatcacctaaaacaatttcactgccatctttatcaataccaatagtttcatttaatgaaacatctaagctggtttttttgttggttctaagatgcattaaaatttcattttcgatacatcttgaagcataagtagctaatttagttttatgattttgtttgtagctgtcaactgctttgattaaaccaattgttccaattgaaattagatcttcttgtaaatctttattattttcatattttttagcgatatgagcaacaagtcgaagatttctttcaattaaaatatttctagcttcttgatcaccattaaaaaaacgttctaaatatttttcttcttcctttgcacttaaaggaatttcaaaagatttagatttaatgtatgataaaaagaagccgtttgttaataatgatagtattgttgaaaacatgaatttcacccctgatacatatatattgtaaatcttttattttaggacaaaatatttatgaattgttcattttatttactttaaaagtagtgcaaaataaggtacaatggggatagttttgaaaaggagaatgtatgagcgaaaaaataagatgttttggctgtggagccataattcaaagtgaagatgaaaaaaagattggatttatccctaaaaatgctttaaataatgaaaaggttttatgtaaacgttgttttcgtttaaaaaactatcatgagttacaaaaaacaaatcttacaagtgatgattttttaaatattcttcaaaaaataggtgatcaaaattgtttggttgtctatttgattgatttatttgattataatggaagtttaataaatgggttgccgcggcatttaaataataatgatattctcgtagttggcaataaacgtgatattttacctaaatcattaaaagatattaaaatagaacactggttacgtcgtcaattaaaagaaatcggcatcaaaccagtcgatgtgattctatctagtggggtaaaaaattataacttagatctattgatcgataagatcgatgaatatcgccatggtcgagatgtttatatcgttggagtgactaatgtaggaaaatcttcgttaataaatgcgttattaaaacattatggcagcggtgatgataatttgattacaacgagtgaatttcctggtacgacacttgatttgatcgaaatccctttagatgatcaaagttatttatatgactctccaggaattatcaattcgcatcaaatggctcatttagtaaaagatgaagatcttaaagtaattattcctaaaagtgaactaagacctattaattttcaattaaacgatcaacaaagtttgtattttggcggtcttgcccgaatggattttataagtgggaaacatagttcatttacttgttattttcctaaattacttaaaattcatcgtaccaagttagaaaaaagtgatagtttatacaatcgccacctaactttaaaaccggaaattgaaacaattaaagatattaaagaaatgaaagtttatgattttaaactaccacaacataaggtggatcttgttatttccggattaggatttattagcgttaattgcccaaatgcgaaggtaaagattcatgttcctaaaggtattggggtatttattcgcgaagctttaatttaagaaaggatttaaaatatgttaacaggaaaacaaaaaagatatttaagaggaataggacacaatttaaatgcaattttccaaattggaaaagaaggtgttcaccaaactcagatcgaaggaatcgatgctgctttagaagcacatgaattaattaaaatcaagatcttagaatcttgcagtgaaactaaaaatgaagttgcaattgaaataagcatgaaaacaaaagctgatgtcgtccaaattttaggcagaacgattcttttatatcgtcctagtgaaaagggaatctataaattaccatgatgaagatcggtatttttggcggcagctttgatcccattcatcaatcacacataagagtgattgaagaagctttaaaacaattaaaacttgataaaatattagttgttccaactgcaaataatccttggaaagatactacaggagctaataaagaacagcgtttagaaatgttggatcttgctttaggacgatatcgtagtgttgaaatttgtcgttatgaaatagatcaagatggcagcaataaaaattatacgatcgatacgatcaattatttaaaatctatttatcccgatgaccatttgtattttattatggggatggatcaggcaagtctttttcataaatggaaagacgctaaaaaaataagcgagctagtatcgttagtagtatttgaacgccttggttatcaaataaatgataatttaaaaaaatataattttactaaattagatcttattgctagtgatgatgccagcagtgatattcgaaatggtaaattacatgccttgactcctgaagttttaaaatatatcgtagctaatggcatttatttagaaacgatcgttaaaactaagatgtcaaaaaaaagatatattcacacagttagtatggcaaaactagctaaggaaattgctgaaagtaatggtttagatggaatgaaggcatatgttgctggaatgctgcatgatattgctaaagaaatgccatatgatcaggcactagctttaatgaaaaaatattttcctgagtatcttgataaaccagaaccgatttggcatcaatggttatcatatcttgtggctaaagatgagtatttagtagatgacttggagattttgcaagcgattagacatcatactacagcttcaatcaatatgtctaaattagatatgtgtatatatgaagccgataaatatgatcctagtcgtgattatgactctagtcaagaaattgctttatgtaaaaaggatgttgtggccggatttagagcctgcttaaaagatttttatgatttttcaaataaaaaagggcgaaaaatcgatgaatgtttttttgaaatttataacaaatatgtaaaaggagatattaatgaataaattagaaattattataaaagctttagatgataaattagcagaggatattgttgcaatcgatatggaaatggctagtccaatttatgatacatttgttatctgttcagccgcaaatgagcgtttgatgaatgcacttagagacagtgttgaagaaaatatgttaaatagtggctttgaggtgaaaaaaatagaagggcgccgtaacagtaaatggttattaatggattatggagatattatcgttcatatttttgatcaagatgaaagagacagctataatcttgaaaaattatggtcggatatgccaagaattgatatttctgggtatttaaaataatgtcatatgaaaattttgcttattattatgatagtttgatggatgaacaattttatcatgattattataaatttattaatgaaaaagctgattttaaaacagttttagaacttggctgtggaactggagaaatcgctattcgtcttgctaatgataataagaatgtttatgctactgatttatcaaaagatatgctggaagtggcaagattaaaggccatggaagctaatgtcaatttaatgcttggtcgtgttgacatgagtgattttaaaacagatatcgctgttgatttggttctttgtttatgtgattcaataaactatgttttaagtcgcaaaaaagttaaacaaacatttaaaaatatatatgaggctttgaagtataatggaacatttatttttgatgttgatagtctttataaaatggacaaaattcttgatggttattttgaagaagaagatgctgatgatttttattttaaatgggaagctaaaaagacagcatttggaaaaatcgaacatttaatcgagataatcgataaagaaaataacgaacatatcaaagagttacatcagcaacaaacttatagtattgaaacatactatgaaatgttgcagcaggccggttttaaggaaatagagcattatggtgaatttgaaaaatatcatgataaatcacaaagaattatttttgtctgtcgcaaaagaagggatgggaaataaatgatcggtataattggagcgatgaaagaagaagtagatgcaataaaaaaatatatgaatattgtagatacgaaaactatcttagactgtactttttatcaaggaacgattgaaaacaaagaagttgtcttattgcaagggggaatcggaaaagtaaatgcagctatttgtacgaccctgcttttaacaaattatcaaattgattttgtcataaacgttggttctgctggtggtctttgtttagatcaggaagtaggagatgtggttatttcagatgcagtttgccaatatgattttgatattactgcttttcctgatcgtgtattaggtgaagtgcctggattaccgccaaaaatcaaagctgatcaagaattagttgatcgagcaaaaaatgtccttgaaaatctaaaactaaactatacagctggtttaattgtttctggtgataagtttgttgctgataaaaatacagttgattatatcaaagaaaattttaaagatgctaagtgctgtgaaatggaagcagcagcagtgggacaaacatgttataaatttaatactaaatttattattacccgttctttaagtgatatttttgataaaggtgattcaactatccaatttgatgaatatttaaataaagctgctaatgcctcagctttaatgtgtgtatcactaattaaggatcaatcatgaaaaaacaaatagaactattagcaccagcaggaagctatgaagctttgcaggcggctgttcaaaatggtgccaatgccatttatttaggtggtaatgattttagtgcgcgagcatttgctactaattttaatcgagatgaattaaaacaggcagtaatttatagtcatctaagaaatgtcaagatctatgttacagtaaatacattatatgaagataatcagtttgaaaatttaaaagattatcttttgtttttagcatcgataaatgttgatgcattgattattcaagatcttgggttaatggcatatgtaaaaaaatattttcctaattttgaaatccacatgtctactcaaactagtatatatagtttaagtgcggtaaagtattttgaacgtattggtgtcgatagaattgttttagctcgggaaaatagtcttgaagaaataaaaaatatttgtaataactctaaattggatattgaagtctttgtccatggcgcattatgcatgtcatattccgggcagtgtttgatgtctagtatgattgctaaaagaagcggaaataaaggagcctgtgggcagccatgccgtttagcatacaaactgcaaaaagatggtaaaaatctcgatcaggtaccatcatatttattgtcacctaaagatctttgcacaattgaaaatgttggtgctttaattgaagcaggaattacttcttttaaaatagaggggcgcatgaaaaggccagaatatgttgctataatcgttaaacaatatcgtgaagctattgatgcttattttcaaaaacagaatccaaaaaactattctaaacaaattaaagagatgaaacaaatgtttaatcgcggctttactggtggttatttattacaggataaagatttaatggctgatgattatcctggtaatcgtggcatcaagttaggttctgttcttgattatgataaaaagcgaaaagttgtaaagattaaattgatcgataagatcaaacaaggggataggatcagttttaaaagtgttgattatactagaaccataactaaactatttttgaatcatcgattagtaaatcaggctgtagccaaagatattattgaaatcgaattaaatacaccagttaaaaaaggtgaatctgtatataaaataattgatatcgaattaattgaaaaagcacatgacagctatcaaaaagaacaaattaaaaatcctatcacaatgtattttaaagggcaaataaatgatcaccccacacttactattacatatcaagataaaacaattacggttgtatcaaagctaataatggaagctgccagcaaagcaccactaaatactaaacatattgaaaagcagcttagtaaattaggaaatactgtttttaaagctgctgatataattgttgaaattcctgaaaatgcttttttcagtcttaaagaaatcaatgaaatgcgtcgtcaggcaatcgataaattagttgcatctctaacagcttttaattcaatagctccattaatagaagaaaagaaaactactcatttgattaaaacgatcaagggtatttgtgttcgtgtttattctatagaacagttaaaagctttgcttgatgtagatattgaggcttattattttccattatcaccacaattaaaagatgctattgaaattgccaaaaaacatcataaaaaaattattccttttacaggttttttaaatgatgaaaaacagttatttaatttcaaaaacagcaaattatatttagaaatcgatgccatactagttggaaactatggtgctttagaaatatttaatgataaaaagtgcattttagatacaacttttaatctttataatagttatgccttaaactatttaaaagcctatgatgccatcttatctttagaaatgagtaaaaaacaaatcaataatttatcgaatatcacacaaaacataattgtaacagtatatggcaaaacaattaatatgcatttaaagcactgtttaattagtaatcattattttaagaaaaaaatgattgactgtaacatgtgtaaaaaaggaaactatcatttagttgatcgtaaaaatgaaaagtttaggatcttaacagataataactgtaataatctgatttttaatagtcatagtttatatataaataaacttgataatctaaatgtagattttattttgttatcatttagcgatgaagatggtcaaacagcaagatttatttatgatcaattcaaacaaattttatctggtaaaattcaacaaattcctagttttattaatcatacaagtggatatttttatgattaattatcattttttagaaaaaaatgttattctaataggaaataacttataaaaacataaaattttattgaagataactaaggaaaatgctaaaatttatttactggaggtgtggcgatgatagataaagatttagcagccagattaaaatcctatcgtaattttaaacatcttacccaaaaagaagtagccaaatatttgaaagtaccacattctgctatctctgatattgaaaacggtaaaagagatattacagtcggggagcttaagattttttctaatttatatggccgcagtgttgaagaaataatgagtggtaagaaatatgattactataatattgctaatattgcacgacttttgacagaattaccagatgaggatttaaaggaagttatgtttattattgaatataagcgtaaacgtaatgaagaaagagaaaaatagagtgagaaaatctcactctattttagtatctttttaaattcttccaacatcaatatcccatcattcaaaactaaatcggtacattcttcaaacgtagaactatgataatatttaatttcaagttcatcattgataatagtaacgattgcaaatgtaccaaaaccataactgctacggttcatcattacactgccaggattaataatatacttattttcaataatagtataagcaggcacatgagtatgtccatgaaatgcaatatcgatatgcttttttttcataaatgctagtaactgctcattgccgtaataaatattaaatttattaccatgggtaattaaacaacgatattttccggcattaaaaataatattcgttttaaatgttcctggtcgatcatgattgccattaacagtaagatatttttttaatagtggatcatcgttttttaatgatgaatcaccacaatgaatatagtaatccatactaggatatttgtcagttatattttttaaaagatcattttgtaaatgagtatcactaagaattaaaagcttcataatcttcacttcctcgtataaaaacatgtatcatgatgttttattatatcttttatatattaaaaaaatgtgaatttaagggcggaatttagatttaagcttaaataaaggtatcgaaaaaggaaaaaaaagatttaagaaagtgtttacatctaacaacattcgttgtaaaattagaacaggtagaaaaaaggagggtacagtatatgaaaactattttattagtatgttcagctgggatgtctactagcttattagtaacaaaaatggaaggtgctgctaaagaagctggtgttgaatgtaaaatttttgcattgcctttctctgatgcaccaagagtattggaagaagttgactgcatcttacttggacctcaagttagattccaaaaagctgctattgaaaaacttgctgccggacgtaaagcaggtcctattcctgtagatgttatcgatatgagagattatggaacgatgaatggtaaagctgtttttgaaactgcaatgaaaatgattggttaatagaaaagcttgtctaaacagataaaacgggcgttttttataatgccctttttatatgaattgaaataaaggagagagaattatgaaaacaagaattatgttaatatgtgcagctgggatgtctactagcttattagtaacaaaaatggaaaaagctgctaaagatgctggtgatgatgttgagatttttgctttgcctttgagtgaagggggaaaaatgataaatactgttgattgtatcttgcttggacctcaagttagatatgctaaaagcgaagttgaaaaacttattgaagaaacaggaaaagatataccgcttgatgtaattgaaatgaaagattatggaatgatggacggtaaagctgtttacgaatttgctaaaaaattacttaataaatagtttattacatattcaagactgctaagcagtcttttttagtaattaaagagtctaaaaattatttaattttgctcttttttgttgtatacgattatgctataataacctaaataattaggaggttatgatatgcaaaaggggattattacagttgtaggtaaagatcaagttggaattatagctaaagtatgtacttatttagctgagaaacaagtaaatattttagatatttcacaaactattattcaagggtatttcaacatgatgatgattgtggaattaagttcaataactgatgaatttggtactatctgtgaagaattagataaattaggaattgaaattggtgttaatataaaattacagcatgaagatatttttaataaaatgcatcgtatttaaggagaagttatagatgattaatttatttgaagtagcagaaacaaataaaatgattgaacaagaaaatcttgatgtaagaacgattactttaggaatcagtttattagattgtatggatcatgatattgatgttttatgtgaaaatatatataaaaaaattactactgtagcaaaagatttagtatcgactggaaaacaaattgagatgaagtatggaattccaatcgtaaataaaagaatatctgtaacaccaattggttttgttggttctaacgcatgcaagagtactgctgattttgttaaaattgcaaaaacattagataagtgtgcgcatgaaactggggtaaactttattggtggttatagtgctatcgtatctaaaggaatgactaaagctgaagaattattaattagatctattccagaagcaatgaaagtaactagtaatgtttgtagttctgttaatgttggttctacgaagacaggaatcaatatggatgctgttaaattaatgggtgaaatcattaaagataccgcgacactaactaaagaggacgattctattggttgtgctaaactagttgttttatgcaatgcacctgatgataatccatttatggctggagcatttcatggtgtaagtgaagctgatgccgttattaacgttggtgtaagtggtcctggtgtagttaaaactgcaattgaaaatgctaaaggtaaagattttggtgaactatgtgaaatcattaagaaaacagctttcaagattactcgggtcggacagttagtagctttagaagcatctgaaagattaaagattccatttggaattattgatttatcattagcaccaactccagcaatcggtgatagtattgctgattgtcttgagggtatgggcttagacagtgttggggctccaggaacaactgcagcacttgcaatcttaaatgatcaagtaaaaaaaggaggcgttatggcttcttcatatgttggtggattaagtggggcttttatcccagtcagtgaagaccagggaatgatcaatgctgtcaatagaggagctttaacacttgaaaaattagaagctatgacatgtgtatgctcagtaggtcttgatatgatcgctattcctggaagtgttgaagcaactactatttctggaataatagccgatgaaatggcaattggaatgatcaatcaaaaaacaactgctgttagaattattcccgtgattggaaaagaagttggcgaagttgttgaattcggtggattgctaggttatgcgcctatcatgccagtaaataattttggatgtagtgaatttattaatcgtgggggaagaattcctgctccgattcacagttttaaaaattaaaagacgaattttcgtctttttaattacttagaaaggataatataagtatgaatgatttaataatatttttcccattatacaaaaatgatgatataaaagaatgttttaaaatatatgatgagattattaaaaataataatttagaaaatgctaactattttgtttcattactgatcaaattagctgaaaagtataatttatatggtgatttgttcaacagtctattaacacacttattaatcaataatgaaaattcatttactttagcattagaaagaaaagccgctattgctgataatctaaaaaatattgttatcaatgattttaaaattatttttgaaatgtttaatactgactttagttcattgtcgcctttacaacaagatcttattactaactttacaccatcaagaccagtaatcaatcaagaattatttgaaatctcaagatcactgcaaaataatttatctaattgtaaagacgtagaacaattttataatattttagaaaaattctttttaacttatggtgttggaaaatttggattaaataaagcatttcgttatgaaaatcatcaaattagccctataatacatataggtaacggacgtttggatcaattaataggatacgaaagtcaaaaactaaaactcactcaaaacacagaagcttttttagctggtaaaaaagctaataatgttctactctatggtgatagcggaactggtaaatccagcagcattaaagcactattaaacgaatattataaagatggtctaagaatgattgaaatttataaacaccagttcaaatatttaccaagtattatccaagaactacaatcacgtaactataaatttgttctattcatggacgatttatcatttgaagaatttgaaatagaatataaatatttaaaagcggttattgaaggtgggttagagaaaaagcctgataatatattgatttatgctactagcaatcgtcgccatttagtcaaacaaacatggagtgatcgtcaagatcaggatgaagttaatgtaaatgatgctaaacaggaaaaaacatcattaagttcaagatttggaataaaaatattatatactcatccaaatcgtcaagattacctagagatcgtagatggtttagcaaaacagtataatctacaaatgtctcaagaagaattacatcaaaaagctttaacttgggaaattcgctatggtggattttcagggagaacagctaaacaatttattaatgcaatgttaggaaataaatagggagaaatatgcaaaaattattattaagtgattatcaaaaaatcaaaccatatttagatgatgctgattatgaaggttataattcaaattttgtaacaatgatgatgtgggatcatgaatatgaaatttattatgaaatcaaagatcattttatgatcatgttacatacttacatgaatgaaaagttttttgctatgccattttgtaagccggaatattatcatgaagcgcttgaatatatgatgaaatatgcaaaagatcataacttttcttttaaaattgatctagcagtagaaaagtcaaagcaattgattcaagatctgtatggagacaaatttttatatctccataatgatgattttgatgattatatttatagtaaagcatcattagaaacactttcaggtaaaaaaatgcaaaaaagacgtaatcattttaatgcttttcttaaagaaaatcctaattatgtatataaagagattgaagatgaagatattgataatgtacttcaatgtttaaaaaaatgggatttttcaaagcatattgaggaaagtgttatttcagaatatattggaatcgtatatttattagttcatcgtcatgaattgaatattaaaaccggatgtatctatattgataataaattagaagcttttattattgcttcaccactaaaacataatactattcaaatccatgtcgaaaaagctaacaaagatattcgcggactctatgtagcaataggtaaatttttcttagaaaaaaactacgagggatatgaatttgtaaatcgtgaagaagatatgggcttagagtcactacgaaaagcaaagcaaatgctgcatcctatcaaaatgataaaaaaatatactatcgttttgaatgaacaatcaatcgttcaagctgatgataatgatttatatggtattattgatctatggcgcaatagttttaaagatgaggatgaaatgtctacaaatttctattttataaatcgctatcaaaaagaaaatacttatcttttaaaaaatgatcatcatattgcttccatgttacaaattgtcccttatactattcttttagacaataaagaagaaccagtgtattttattttgggagtagctactgataaaaactatcaaaagcaggggatgatgaaaaaactgataaatcatgttttaggattgcctaaatatcaaaatgctaaaataatgctgcaggcatatcatcctgaattatattatcaatttggatttaatgaagattattttcacaaaatcacaaaagttgatattcaatcatattcagccccatctaaacttagagtaattgaaaattacaactataataagctagtgaatttatataattgtttttgtgaaaattttaatggatatcgtaaaagagatatcgaatattacaacaattatttaattccacgctgcatggcttttaaagaagaaattaaagtattttatcatgatatcaaagcagtgggatatgttatctacagcgaagatgcaacaacaattaaaatttctgaaatcatatatttgaatcaaaacgaattaaatgaaatacttaattattttggtaattttaataaagaaataattattgaaagtgatttacaggctaaaatcaatggtgaatgtacatttatttgtacaatgttaacaaatttcttaaaaaataattgtcaagataataatttttatataaatgagtgcttataaatattgactatacctttaatgcattataaaatgtaatggaattcaaggaggtcagcaataaatgtttttacaagatcgacaattgcatgaagaatgtggtgtttttgcagtatgtggctatgaacatgctgcagcaatgtgctactatggcttacacagtttacaacatcgtggacaagaagcagccggaattgtagtaaaggataaagaagctttatcgatccaaaaaggtgaaggtttggtttctgaagtttttgatcaagaaaaaattaataagatgaaaggtgattatgcaatcggacatgttcgctattctactgctggaggtggtggaattgctaatgtccagccattattatttagaactttaaatggttctttgggaattgctcataatggtaatattgttaatgctaatgttttaaaggctgaattagaaaaaaaggggagtattttctctagtacatcagatactgaaatcttgggtcatttgattatgcgtgaagaagggcatatgatcgaccgtatctgtaaatcattaaatcgtttagatggtgcttttgcatttttgattttaattgaaaacgctctttatgttgctcgtgataaatatggattaagaccattatctattggtcaattacctaatggtgcttatattttttcatcggaaacatgtgcttttgaagttgttggagctaaatttgttcgtgatttagagcctggtgaaattgttagagtgaaaaataacgagttaaaatctaaattatatactgaagatgtaacagataaaatatgtgcgatggaatatatttatttttcacgtcctgatagtaatttagatggtatcaatgtacatacaacaagaaaattagctggtaaacaattatataaagaagctcctgtagatgctgatttagtaattggagttcctgattcttcaatatctgctgctattggttattctgaagcttcaggtattccttatgaaatgggtttaataaaaaataaatatgtaggaagaacttttatccagccaactcaagaaatgcgagaacagggagtaagaatgaaactttctgctgtttcatcaattgtatgtggtaaaagagtaatcatgatcgatgactcaattgttcgtgggactacttcaaaacgcattgtccgtttattaaaagaagctggtgctaaagaagttcatgtaagaattgcttcaccagcaattaaatggccatgtttttacggtgttgatatgtcaactatggatgaattgatttctaataaattatcagttgaagaattatgtacgtatattgaagctgattcactggcttttattagtgaagaaggaattgacaaatcaattcattataataaagaaaaacataaatgtggtttatgtctagcttgttttaatggagattatgttactaaattatatgattcatttgaaactgataagataaaaaaaggaaagctatagtttttatacttaatacttagttaaaaggattggatagataatatccaatccttttattttccatcttaaataaataatatatttaacttcgcataatgaatattatgtaaattttattaaaataaatctagtatttaatagtttattgctttcgttattattcgccaaaaacctttatataataacactttatggcgaattatttattataatcattaaatatgctttataatttaataaatttattatcaaattataaagcgtatcttttaattacacttatgtaacaatataattgtttttgtcgatcgatgaaaggagttaaactatgaaaaaagacacaatatatattttagaagaagatataagattagcatctatcttaactgcaaaactgttatcaacaaataaatatcatattttagaagttagtaataatgctttaaattgtattagttatttatcacataatagttgtgatctattaataattgacttgatgctttctaaaattgatggtataagtgttttacaaaaattaaagcaattaaatgaaacagcatataaaaaagtaatttgtatgacaagttttaataatccaattatatctaaattattaaatgatttagaggtcacatattgtataaaatcacctatagacattgattcttttctttcaactattgattcaattataaatgtagatgataaaataattaatctttctaaaacttctaaaaaatacgaaatgattaaattagaaaatgaaattagtataattctaaaaaagacaggtatttctgttaatcttaatggttacatgtatttaagaacagctattatcttagtatataatgatattgaatattttactcagataacaaaaaaactatatcccgatattgctcgccagtacagcacaacagcttcaagagttgaaaagtctatccgtcatgccattaagactgcctggaatcaagatgatggtaaaaaaattaatgatatcttgaaaagaagaaatctatttaaacctactaattccgagttcattgctttaattgctgataatcttagaataaaaaaggcttaaatgaaagaatataaaaagaagttaaaaacttcttttataatgctaaattattaataaatgctgctgtattaataataataaaaacaaaaccaacaataaataaataaagatataattttatttgtttattgtttttatagttattaaacaatgccagcattgcacaaataatcaatatcattgcaataatataaaaggtaataatactgatagatgctttagttaaaagtccggctgcaaagataaatgttcctactgcataggctaaaattgaagtgattattaaacgtttactattttcttccataaaaatctccattatattattttatttaaaattgaaataccgatcgctggtaaaggaacttcaaaattatcagcaatagttgcaccaataactgcaaaagaatccatttcttctaattgacgtggttttaataattcttttgaataaattattaacggcacttgttcacgggtatgatcagttccctgatacgttggatcatttccatgatcagcacttatcatcagtaaatcatcatgatgcaaatatttcatcaattcttctaattgtatatcaaattctttaatagctttaccatatccttcaggattacggcgatgaccgtaaacagcatcaaaatcaactaaattgacaaaacataaacccgtaaaatctgctttagctaattcaatcgtttttgccatgccatcataattactttctgtttttacttttttactaattccctgattatcaaaaatatctgctattttaccaacaccaatcacgtcataattattttcttttaaattatctaaaacagttttgctagagggtgctaaagctagatcatggcggttagcggtacgcttaaactcccctgctcttttacctatgtatggtcttgcaattatccttccaactttccagcgttcattcattgctaattcacgagcaatctgacaagcttcgtacaactcttctagaggtatgatttcctcattagcggctatttgaaagaccgaatcagctgaagtataaacgatccaatctcctgttttgatttgatgttcaccatattcatcgagtatagctgtaccactggctgctttattaccgacgcatttacgccctgttttttcttcaaataactgaataaattcgtctggaaagccagtttctgtaaaagtaacaaaaggcttttctgtctttaatcccattatttcccaatgtcctgtcatagtatctttaccgttagaaatttcatttaatggtaaagtatagccaagctgtagtcttaaagggttgattcctttaaaatcacctagattacctaagcccaagccttctaaatttggtaaatctagaccattgcaataatcacaaatatgttttaaagtgttagctccttgatcattaaaagcaacagcatcttttgcattacctattcctagagaatcacatataattaaaaaaattcgtttatatttcatttttcctccatttccagcatgattcatgcattatttatctatatccttttttattcgtggatgaaattgctgatattctttttttattttttgatttgatatatgagtgtatattgtcgtcgtgcttatatcactatgtcctagcagttcttgaatcgaacgtaaatcagccccattttctaaaagatgagtagcaaagctatgacgaattgtatgtggagatacttttttgtttactgatgtctgtctaataatttgttttaaaataatataaaactcttcgcgactcattctattaccatgattattaaaaaataataatgaagattcttttttgataaattcttcccgataattatttaaataatcacccaatattttttttgcaactgcaccaataggaacaattctttctttattcccttttccaattacttttatataacccatataaatatttacagaactaacattcaaattaattaattcagatactcttaatcctgtagcatacatcagttccaacatgcagcgattacgcgaactcaaatgatcttcaataacgatactatctaaaatttcctgcatctcttgttcacttaaaacaacaggtaattttttatcgatttttggtaaatcaaaatcattcataatattaacatctatgagcttatctttcactaaaaaagcaaaaaacattcttaaagaaactaactttctcgttatacttgtagaactgtttatttttgataattcttttaaataaaggcgaatatgttctttagaaatattttctatttcaaatatttgatgaatatcatttaaatagataaaaaatttatttaaatcatttaaatatgctaagatagtatttttacttaatcctttttcaacgatcaaatactgtcggtattcatttagactatcttttaatttcatcaatctccacctcttatactaattaattatatcatgattaaaattaaattttccattgatttgctaacttaaagtgcataaactttaaaagccattgacaaagttacaatgatcaaaattacaataacataatctaaaatataatttattatctttcggctattgaacacttctctagtaataaatgtaatcgtaaaacaatttaatgataacctaagtgaaattattgatattatataagttaatagtaattcaataaacaattgtggtatatatcctaaaaaaaacatactaatactaaagtcatttaaagtaaaataaaaaatggttgcgatcgtaaattgcattcctttagtaaaaataataaaactattaaaaaacattcctaaaaaactcgttgaaataaataaagataaaaatatgtatataccagtaattgtcatatatatattataattattagttacttcattatctttataaaaaaataaatatttgcaaaaatcaatcagattttcactaccataaaaataataaataattccaaaaataatcccgcagcttaataaaacaactgaaaaaagattaattaatactttttcatttttaaaaattttatttataatgcccataagtagtcctccgtttatataacttatgagcaagataaataattattcatttattttaaatatttcttttgaatacctttattagaaacagctgatgccttagttacgatcggtttatcaaacttattattaatattttctataattgtttctaacgcttccttatcaccttcatttttagaagtatcaaaaatactcagctgctctttataatcctttttattgatagtattatttaaactaatgcctaataaacgtactggtcgaccatcataatgggcatcaaaaagcatcttagcagtagaaagaatagtttcataatcatttacatatgaattgatagctgtttggcgattaacactttcaaaacgagtatattttattgtgatcgatatcgaattagaaataagatttctttttattgctcttatagagacttgtttagctaatttttttaaagtatccctcaatacgacctcatctaaagtatcatggggtaatgtagtagaattacctacagattttaattcgttttgtttagcatcaactgtgcgaatatcgattccgttggctttacgatataatagtaaagcatttttaccaacgatttgacgcaatttattataattatcataattagcaatatcaccgattgtattgattccaacttcttttaaacgaggtgtagttttttttccaattccaaacatatccttaatatctaaaggccacattaattctttgatatttgatcgtgttaaaatcgtaatacccattggttttttcatatcactagccatttttgctaaaaatttgtttggcgaaatgccaatcgaacatttaagatttagctcgttataaactttatcttggatttcttttgctaactgcatcggatgacaatttctactttgaataattttagtaacatcaacataacattcatcgatactagcaacctctaaaatatcactatatgatgctattatattaaaaaaatcattagataagcgatgatacaattcaaaatctgctggtaaaacaatcagatttttacatttttgataagcttgaaatagtggcatcgcagaatgaattccaaacttacgagcttcataggaagcagtagtaataatacttcgttttgattttcccgaaataacaagcggtttcccctcaagtttgggatttcttgatatttcagcacttgcataaaatgcatttaaatcaatatgaaagattatttgcattacacaacccctcctaaataaaaatcatctggacacaaatcatataactgatagtccctatgataatcgataataatgtattattttttaataagtgcactacaataataatcgaaattgcgattatttctggtaagccatgatttgaatcaaaaaaatttatatcttttaaacaatatacaactagcatggccataacggaatatggtaatactttacctaaataatcaatcaaagccggttttttacttggatcattaaaaataataaaaggtaaagctcttgtcaaaatagtgcctagagccacaactattattatcatcatatctctattcatattcattttctaaatcctttcttttaaacattaaagccccaataattccaattaaagatacgattacaaaattatcgctaccaaatataagcaaagaaacaatactaacaataaaacctatttttgttgctagatgattttgactgttttttatttgatctattacaattactataaataatgctgtcattgaaaactctaatcccctactatcaaaagtaataatatttgaaatggtagccccaatcagtgacccgatgatccaatagcactgatcaaaaagactaataaaaaaactaacatatttattttgctgatcatctttgattaaaagtgaaaaagtctcatcagttaatgaaaaaatcatatatggctttaaaactttcattttttcaaatctatttaacattgataaaccatagacaatatgtctagcatttactactaatgtcatgataaaggcatttaaaagtgaacttttagctgttaatagagaaattgttacaaactgcatactgccagcatagataaaaaaactcataattaaagcataataaataggatagtccttacttacaagcaaagcgccaaaggcaaaacctaatacaagatatcccatcattaccggaatagattccttaaaggcttctttcaatattttaaaattcatataaatcctccaatgacactattatactaaaaaagtttatttatgaaaagtaaggttaaaaaagataaataatagtcatttaaaataaaaccaggagcagaaacttttaagtctcatcctcctggtatatttttgtcatctaaactaatgactttggcccttaaggcaccattgttatctttgtttttccatttccaacatccattctatatacaaaccaaaacctgtcatcggattatttccagatacgtgcgttacacaaccaatgatcttatcatcttgaataattggtgagccgctcattccttgaattataccattagctttatcaataacattttgatctgttactttaaactcaattcctttttctttaactgaatcttgatcatttaacttagtaatttcaatttcacatttttggatttcctgaccatttaaaacagttaaaaaatatgcttttcctaatttgatttcatccttgctggctgtatccattgcttttctgttagaaatatcgtaattataagttccataaataccaaattgattatggctgtttatactacctatttcaatattagaaatatcagcaattttattaccagagctgttaggagaagcttttttaattcccgtgacactactttcataaatattaccagattgcagtaaactattggtatttaatttagtatcactcattgcatgtcctaatgcgccaaaggtattatcggcgggattatagaacgttaaagttcccacaccagaaatagcatcttttacatataatccggttgtaaattcctgattttctaaaaaaacctggagattacgatgaagtctttctttatctctgataatagttaaatcgtaattacttttttcactaccaccagttttaataaattcacttaattcttcaatcgtagttactttttgtccatctatttcaacaattatatctccgactttaaaatcttctgctaaagggtcataagttgtatcagcagttttaattttatatccaccagttattacaacgccctgataatttaattcaattccaattgaatcaccaccaggaatcaatgatattgcatataaagcaatgggattaattgtaatggctaaaataacaattaaggaaagtattagctttttaaaaagcatagaaacctccttgtaacaaatgttacaatctagtttggtctctatgctaataattattcactacatgcttttaatttttttgcatgctcgattgattctttagaaatatcttttccagaaattaatttagcaatttcattaatactttgattttcgtctaattcagaaatcttaacctcagtattattattagtagcagttttttcaatcaaataatgatttttagcaaatgcagctacctgagctaaatgggttatacataaaacctgatgatttttagcaattagttgcattttagcaccaatgctttcagctactttaccacttacaccagtatcagcttcatcaaatataattgtttcaatagtactagttgctaaagaaagagtctttattgccagcatgattcttgacatttcaccaccagaagcaactttgtttaatggttttaaagattgaccaaggttagttgcaatcaaaaaagttatctcgtcctggccatctttttgcagttctttttttccaaaatcaactttaaaaattactttatcaagatataaagattttaattgaaccattacctgttcagtgaactctaaagccttttgtttacgtaatgtcgtgatcttgttagcatattcagttgctttgttaaaagtggtatctaattgattttttaattcatttaagtatatctctcgattagtaaaagcttctattttattttccagctcttttttagcttcaataattgcttcaagagattggccatatttacgttttaaacgatttagcttaaatagagtatcttgtatttcatttaaacgatattcatcaaaatcattactgttaaattcatcttgtacctcttcatcaagatcaatcaaattataatataaatcatacatcttttcataaatagcttgataagcaggctgttcactaagcgtttctaattcatttatagcactatttaaaagtgctaatacaccttgactaccactgatataatggcgataattagtgattttttcattagttttttcataatttagtaatgcttttttttcttgttctaactcttcttcatcgattgctgatagatcaatactattaatttcatctagctgactttgataaaattccaactgctcatcacttaattcttcttcaattgttttttggtaaagtttttttgtttctttatattcttggtaaacatctaaatactggttttttaaaactgttagagagttgccaatataattgtctaaaatatttatatgattattaggatcaaataaactatgtgtttcaaattgagaatgaatatcaattaattcactcataatagattgtaaaaccatttttgaaacatttcgataatttattttaataactgttttattatcacgattaaaagattttgatactactagtttatcatcaaattcaattcgatattccttcaatttatttaaaactgaagaattatctttaatcgtaaaaattccttcgataaatgactcattacagccgctttttataaagctggtttggctgcgattacccatcaattgaccaattgcatcaataataatcgatttaccagcaccagtttcaccagttaaaaccgtcatctgatcatgaaaagatacttccaaacgatcaatgattgcaaaattttcaatatagatactctctaacattttttcacctacccttcaaaacaattatgtgcgctctctactacattttcgatattaatagcggtttctttgccttctttaacaaatagtcctaaaaactcaatatttccttctccaccagttattggtgaatatgtgagcttttctaaaataaagccatccgctctagcaaattcaattactttttcaataacacgacaatgaatctttttgtctttaacgattccttttttaccaacatcttcacgacctgcttcaaattgcggttttattaaagctacaacttgatcattaaaacttaatatattttttaaagcatcaaaaatatattttaaagatataaacgaaacatcgatcgtagcaaaagaaggaactccattttcaaacaattcaatcgtagcataacgaaaatttgtctgttcttttacgattacacgaggatcattgcgtagtttccaaactaactggttagttccgacatctactgcgtatactaatttagcgccgttttgtaacgcacaatcagtaaaaccaccagttgaactgccaatatcaaccataattttatctttaagatctaaagaaaattcttttaaagctcgttctaattttaaaccgcctctagatacataaggcatgatatttcctttaacatgtaaattagaatcgatcgggatctttgttcctggtttatcaattatatcataatcatcatgaacaattccagccatgattgctcgtttagctttttcgcgcgaatcaaaaaaaccttgttcaactaataagacgtcaattctctcttttttcatcaattatctccttaaccttttgataaaatgattccatatctaatccttcatcttttaaaatttcttcgatactaccctgaacagaaaaatggtcatcaacgccaaaactataaatacgctttaaaattcctttttgactataataataagcaatattactagataaagaatttatttttaattccgtttcatatacgatcaatggtttatcatcaactagtctatccaatagttcaaagtccatcggtttaataaacttagcatctactaagcgaattttaatatctttatctttataaaaatcacgaatcatatttatgttttggccataactaataatagtaatctcatgatcatcaaagccttcaactgaccatttaccaatcggtaagatttcttcaacctcggtatcatcaatttcgatacttccacgaggaattcttaaaatataaggatgatcattatattttaagtatgtattaataaatcttttaacatctttactattacttggagtacaaataataacgtttggtaaaggatttaaaattcctaaatcaaatacgccatgatgagtaggaccatcagccccgacaaaaccacaacgatcaacgcaaattaaacagccaagatccattctggcaatatcatgattgatttgatcataagcacgctgtaaaaaagacgaatatacagaaataaacggttttttatgcgcaatagatagaccagcggtaaaagtcaaggcatgctcttcagcaattccaacatcaaaactgcgatcaggataatgtgcaaaaatactatccatcgcggaaccatgaatcattgctggtgtaatcgcaacgatatcttgatcacttaccatctttttttcaatatgatcagcaactaatttagaccaggtcgttttatcttcagattcgggattttttattgttccatcactaatattaaatggcgcaattccgtgccatttaccggcaaaatcattttcggcgtaacgatacccttttccttttttggtaactacatgaacaacaacacttgttttagaagctttggctagattcaaaactctgattagatcatcaaaatcgtgtccgttgacaggtcctaaataatcaacaccaaaatcctcgaaaattgtgtcatcgatcaaaccatgctttacaaaatctttgacgcgtttagaaatattgaaaatcattttaccaaatttattttttgaagtaatgttacgataatcttctttcaaattattataagttccgctaagtcttattgaagataaaaaatcattaaatccgccaacacttttacctattgccatttggttgtcattcaagataatgatgactttattattgatagaaccaagatgatttaaagcttctaaagactccccgccaaccattgcagcatcaccaacgacaggaataacattaaaattttgcttatccaaatcacgagcgattgccattgctacagcaccacttaatgctgttgaggaatgtcctgcttcccaaacatcatgctcactttcacaacgtttttgaaagcctgataacccctggtatttccgcaaagtattaaattgactagctcgacctgtaaggatcttatgaacataagactggtgtcccacatcaaagaagattttatctttaggtgaattaaaaacataatgtaaagcaattgttaattcaactacacctaaattacttgaaagatggcctccagtttttgaaatattattaattaaaaattcacggatatccgaggctaattgatttaattgtctaatatccagctcttttaaaaaagagggatctttaattttatttagatccattatttcactcttctctttattttttttattatttctaaaatcacttcatgattaatttttaatttattgataagttcatctacctcattgaaatactgttcaattatttcttgagacttttcgattcccatcaaagaaacataagtggatttatgattttcaatatcactacctacgttttttcctaaaatttcactatttccaattacatcaagaacatcatcttgaatttgaaatgctaatccgattttatagccaatttcctgccaaatagcagcatcatttttattagcgatcaaagcgcccattttcatcgctgcactaattaaatcaccggtcttatgacgatggatcaaatctaattcctgttgatcagctttttgattttcatacttcatatctaatgcttgtcctaaaatcatgccatttacaccacttgcctgatacaaagtttgtagtaacgagatttttaattcattattaaaatcagcttctaaaataacatttactgcttcattcaacaaaccatctccggctaaaatcgctgttgcttcatcaaactgtttatgacatgttggcttaccgcgtcgtagatcatcattatccatacctggcaagtcatcatgaatcaatgagtaagtgtgaatcatttctattgcacaggcagcatcaagataatcatgataatcaatgttataacttctaattatttgcagcatcatcaccggccgaatccttttaccacctgccattaatgaatatcgcattgcttctttaacagtcgaatcttgaaatctatcaattatttgtaatagcctgtcatttatttcactaattaatttttccatctgcttattcctcgatctttaaatcttccaattttccatcaactaagatcttagctactttgttttcaatccctgctaatttatcactacaaattttagatagtttaattccttcttgaaataactcgacactattttctaacgatgtttgattatcttcaagttctttaataatttcttcaagtcgcttcatagcttgttcaaatgtaatattgtccataatttacctctattcaataatagcatttttcatgccgtctttcattttgatttcaactttatctcctgatttaagatctaatgatgaagagataagtttttcatcttttaatatgattgcatatcctctttcaagtgtttttaaaggagaaagagtatttaattttgataatgtaaaataaaacttttcctgatcagattggattttttgcttcattaactgctgcattgcctgcaccatcaaatttatatgattttgctgagtaattgtaaataaattagtttgatgctcaaaagattgtatcaaatgtttcattttattactctgattcgttaaattataagcaaaaacatcatttaagcgatcgtataagtaatctactttagcttttttatcttcaaataatttatcaggatttttaaataagtaaaatgattttatctttgtaagagcttgtttattcaaagcaattttttgtttcattaaggtatttagcgtatactgtaaattatttacattttgttgtaattccactaaatctggtgttgctttgatcgctgctgccgttggtgtagcagcacgatagtcagaaaccaaatcacaaatcgtaaaatcaacctcgtgtcccacaccactgatgataggtgttttacaattatatatcgttctagctaaggcctcctcattaaagttccataaatcttccaaagatcccccaccacgagcaataataatagtactaaaacctaaatcatcaacataactcaaagtttttattatttgcaaataggcatccttgccttgaaccggaataggaaatacgattacgcgaacaacagggaatcttagcttgatcgttcttacaatatcggctaatgcagcactaggatatgctgataaaacagcaattttactaggaaatttaggaatctttgatttatgatctaaatcaaataaaccttctaaaagaagctgtttttttaactgttcatatcttaaaaaaagatttcctaaaccatcctgctcaatattatcaacatatagctgatatgttccagcaacgtcatatacagatacactagcctgtatcaacactttcattccattttctagtttaaaaggaatttttttagctttcgaagcgaacataacagcatttattcttgaatattcatcttttaaagtaaaataaagatgtcctgaactatgatgcttaaaattggaaatctcaccttttattaatattttttgcaactgttcgtcagcatcgatccgagcttttaaataacgatttaaagcgctgactgttaaatattttttttccattacttgatcttatttaataatccattgataaatttataagcatcttcatcacaatatttttttgaaagttcaacagcttcattaataataacttccttactctgttttgtttctaataattcataacatcctactaaaagaattgctagctccatcttagataatctttcaatagtccagcctgatttcaaatatttagctacttctgatttgtatttttcaatctcattagcaatgcttgtaattaacataaaacaataatcataatcatctttatcactaacaagatctttatcactatttaaatattcacgtacttcatcttcatttatatcaacaagtaatttttgataaatcgcaataactgctttttctctaattaatttttttctatattttttcatttaaaccgtccttccaaaacatctaagatgattttaccatatttatatcttaaaataaataaataaaaagattatcaaaagataatctttaaaaattaatacctttaacttcaatattgactttaatattttttattcctgtcatttcaaaacagctttgtgctatcttgttttgtaatgcattagttgtagatgtaacattcaaaccgtaatcaattaaaatagcgacatcaacaattacctgattgttcttatttaaacgtactgttactggtccactaccaggcattggaatcatatttccttcaaaatctacaccatcaattgattctacagctttaataacaattgactgaaatacatttaacccaatatttaaagctcctaaatttgtttctttttctactgaataatattcttgactcataacaaatgctcctttatatacctttattgtatataaaatcaagaaaaaattcaagcctcactaataaacttaacttctacttgatattcattcttagtttcttccataattgctttaattatactattagcatcatttccactaccatcttttttatcaacaacgaccttgacagtcttattttctacttcaacaaagacatttttaaatcctgcttcatttacagtctttgtgatttttgcttctaaagctgctgtttctttagcttcactaattgtggctaaagctgatgctattttatcactatcactttcgcttgaagcaataatagcattattttcactgattagatcttctctttctttatctaaattcttttgcagggcttcgatttgagacacctcctgattatttacagcaacttcattagcagtattttctggtggtagtagaatataataaattgataatactaaaattagactaaataaagttaaaaaagtaattgcttgtctattcatgttctttctcctttatcaactactttattatatgcaagaagaaaaaaagtatgaaaaaaacactagttcaataaaactagtgttaagctctaccttgatatttaccatcaactgtatttacaataactatttcaccttcagaaatgaataaaggcactttgatttgatatccagtttcgataatagcatttttagtagctcctgttgcagtatcccctttaacagctggttcagtttcaataattttaaatggaacattgataggtaaagaaactcctaaaacttccccatcatagctagttacttcaacttcgtcactttcttttaagaaattaatttcccattttaaattatctgcaggaatttcaatttgttcataagtttcattatccataaatactaatgcatctccagagttgtatagatattgcattttatttttatcgatatgagctttttttactttatcatttcccccaaaagtaacttctgtagttgatccagatcttaagtttttcatcttgattctaatatttgcagctgcacgagctgttttattatgtgaatagtctaatacaacatataggttaccttcatattcaaaagtaatacctggtcttaaatctccaacactaatcattttaaataatctccttatttgtaatttactttgtgattatatcaaaaattattgataaagtgaagtgattttgataattattgatactctatttttaatttgctgctagaaacaaaattttattgagatgataaactacttatcttattgatatttataaaattaaaacaatgattttatcattttataatgttaaaatcacttaatttaatatatatagatttttattatttgtatggataaaaaaaatagatttattgatgaagaaaaatcaaaagagtaacaaaaagatcatcaaagttattttagccttattgcaataataatatttgttttaatgcttatttacaaaatgatttttttatttttgaagtaatttatgattttttggtgtaaaagataataggaggaaattttatgaatgatctatttgaaaaaataataaaccatgcaatcgctaataaaacatcagatattcatctattattaaaacagcaatgcactatttcatttcgtcaacagggcgatctagtactttatgatactttagaatataaacaggggataaaattaataaattatattcgttttaaatcaaacattgatattaattatcagctaaaaccacaaactgggcatttaaactatcaatacgacaataatgtatattatttacgtgtttccagtttaccaggaaaagatattgatagtattgtaattagaatattgaataatcatcgtaaattatcattagaggaacttactatttttaaagatgtaaaaacgtttttggcccagatcgtaactttaaattccggactatttattgttagcggggcaaccggttcaggaaaatctactactctttatacgttgttggatacaatcaatcaaaaatatcataagaatatcgtaactttagaagatcccatagaaattaaaaaatcttactgcttacaaatccaaatcaatgaaaaattgggtattacatacaataattcattaaaacaaattcttcgccatgatcccgatataatcatgattggcgagattcgtgatgaacaaacggcaagattggcaattacctgtgctttgacaggacatcttgttttaacaacgattcattccagtaattgtttgacgacgattagacgtctattgaacttaggaatattaaaaatagatatcgaagatgttttaattggcgtaatgtcacaaaagatgctttatcataaaaataagcatacaccgcttgttttaccagaatatttagatcgtagtaaaattaatgacttttttaataatcaggctgttgattaccttacttttaaagataatgcgaaaatcttattggaaaataacatggttaattatcaacaggtagcgggaattttttatgaatgaagaatatcgttttttagaaagcatcgcttattttttgcagcaaggatatttgattcaagatattttagagatatgttcttttatatatggtaatgaacgaattgaagatctaaaagagaaattaaataatggtttaacattagatgaagcaataattgaaggtgattttaatcaaacgttcgttgaatattttaaattttttagaattaaaaataatttatctaaagcaattgttcaaagtttaaatatttgtaagacaagagacgaaacatttaataaattaaaaaaagaattaacttatcctattttattgattatctttttaatgatgttttcattgtttatcatttatgccttactaccctcgataatgcagctttttatcgaatttgccattgaacctggttttattactaaaatgatgtttagtctatttaaaatcattccccttcttattttaattattttactgtgttttagcagtgcttgtttgataactgtttatgcaataaaaaaacagtattatcaattaatagattttttagtaaatcatgtttggttcattcaaaaaatgattcaaaaatattattcaattaaatttgctctatattataacgaactattgatcaatggttatgatactacagatatcgttgtaatgctttatcaacaaattgatgatagtgatattaaaatgctgatatatgagatatatttaaagattttaaagggagaatctttagaacagatcatttctcagtttaactatttcgagcctctttttattgctagttttaaattattaattcatgataaccaggctaataaatcacttgataattatttaaagatttctattgacactttacattttaaagtcatgaaaataatcaagcttgtcgtaccattaatttactgttttacagcaggattcgttattttagtttatgtttcaattgttattccaatgatgtcaataattggtaatttatagtactttaaatatttcgtgatatttattacaaacggagggaaaagatgagacaaaaaggatttactttaattgaaatgattttttgtatttcagttattttagttattttattattagttataccaaatgttacaagcaaaaacagagtcgttaaagaaaaaagctgtgatgcccaaatcgaagttgtaaattctcaaattgttctttatgaaattgaaaatggtcatttaccagcaagtatttctgatctaacatcaggtgatcacccttatttaacagaaaaacaagtaacctgccctagtggtttaacaatttctattagtgatggtcaagcttatgcaagataaacatggctttacattaattgaagtagtctttacgattagtatcattattattctaagcgtttttagtctgcattttgcaattactaccccactctgcttatctattgatcaacagtgtaaacaaattattgctttattacaggaagctaaaactcaggctttattaaatcatgaaagaatcgatattttaattgatcataatcgaatcagttatgattatcagggtgaacaaaaaattgaattagatcgtaattattattttcaaaatagctttgaactttattttaacgaaaatggaaatattaataaaggaaatcacttaactatatgcaatcaaaatgattgtagaagtattgtttttaatgttgggagcggtacattttatgttaaagaataaaggaatgactttgattgaaagtttgttggcatttagtatttttattactattatcgtagtaatttttagttgttatagtgctggtatgcggcattttcaaatcaataatgatgattatcaaaattatttaaaacagcaaaacgttaaggagttacaattatggcaaacaagagcattggatcaatcaataaaagaggttttaccttaattgaaattttattttcactttcaatctgcctgctgattgttttaaacagtgtaccacttattaaaacaatatcttataaagataaacttaaggtaaatactagcttttatgctatcggagcaaaacaattaactaagatcttatatacatctaaagatattaccgttggtgatcagttatcctataaggatagtaatgatcagttatttacaatatctctgcataaaaaaagagtagtcaaagaacctggttttgatattataatcagagatgttgaaaacttagatttttttaataaagatgaaaatatttatatgcatttaaataatggtaaagatgatttttattatttaattgccacaaattatgagcatactcataattttgaggaaacaaataatgaaacacttccataaaggtacgattttacaattagtattaattatttttatggttttgagcctaaatatcggagtgttttttactgacataattgaaaacagtaaagcaatagaaagaattaaaaaaattaataatgagcgtttagttgagcttagtatattaagatattataaagaaatgattgctaatgatattttaattagtgatattatcatggttgatgaatatatcattgagtacacagtagatgatttaggaagctattattatattgtgacaactgttagaaacgataaacaagagtatagttttaacttagaaatcaatattgatacattaataatttctgcatttgaatatcaataactaccattttataaaaagataaagtatttgtttaaaagttaatagtaaaaagaatcagcagtaatcagatgatttattagttgattctttttatataaaatctattttaatttaagattgattattaacgttcctttaacaaagtttagtaactatgaaaaaagatatttgaatattatcacatgctataaaaatcaattacttaaaagtacttacattttaacaattgatgacgctataaatataccagatagagataaatcatcataaataatgatttaccaattgaattttaaaaatcactacatacaatcttaatgaaaaggtatgaacaataaataaacttatgaatgactattaattcgttaacaattaaataatttataaccaaaaatagaaatgacttatttaattaaaaataatatgcttctagaaaagaattataaagatgtacttatctatgttataatgtaataaattaaaatacgattttgatagtatacaattcatagaaaagatgaattatgctagtgatatgataagtgtaattttaataacttctatttaatatatgaaaggaaaataaatatgaagatcaaaaatacgaataatgataaattagcagctggattaattctaggatttatggccggtcttatttttgataatttagcatttggcttaattgctggtgtaatattgggtagcctgcctagtttaaaaaatactaaaaagaaataaattatatagttaatctatacgattgatgttttctgcgcacatcttttttaaatcaagaagtttataaaaaatagtaaaagaaataattcgcttcttttactatttttatttcccttaaaaataaggattatatgtctgttcctcttttaatgttgtcgcaggaccatgtccaggatatactacagcatcaaaattatattctttgatttttgctaacgattcacgagtatcatgtttagaagaatttggaaaatcaaaacgaccaatcgatcctttaaataatacatcaccagcaaaaatcacattttctttaggtaaataaatcatcgatgatcctggacaatgccccggtagatgtaaccagcttatttcaaagttgccgattttcattcttttatcacttttaattaccggtgatttgactgtaaacggcttttcgaaaactgataaatttgctttggaatcatgtaatagcaagatatcatcttgatggatataaataggacaatgataatgttcatataaataatcgactgctcctatatgatcaaaatgaccatgagttaataatattgcatctaagactaattcattttcatttaaataattaataatctttttaccgtttgcaccaggatctacaataaaacaatgctttgtatcatcactaacaacataacaattagtttgcatatttcctaataacaatgtttttactttcatctttccacctccaataaagaaaaaaagccgttaggcttatttcttttctttatgtacagttttcttattacatcttggacaatatttatttacttccattctatcaggatgatttcttttattttttgtattaatgtaattttcttcaccacattcagtacatctaagaatgatattttctctcattacttacacctccatttgtaaacttccgttaaatatcttaacatagtatctcgttaattactagtttttttttaatttaaaccatacttttctacatatttatcaattatttgttgtgaaatcaacggtgctgaactgctgcttccatttgatgctgttgtctgtcgtatcgcgatacaggcaaaggctacgattggttcagagttttcatctgcctggatatatccgatctgtaaatggtttggataatcggtctctcctgttcccgtataatcttcagcagtccccgtttttgcatatgtcacataaggtttgctgctccaataggcattacatgtcccgctgcttcttgttacacaggctctcattccctgtttgatttggctaaaagccgtcgtttgctcagatacatcatctaacacttctgttttggctgtatagttggcatttgccagtccatcagcatctgttacatatgaatctaaaaataaatgtggtttgattctctttccaccgtttgctagtgtgcaggcatactgtgctaactggatatttgtatatgtatcatattgtccgatcgaagcatctaataaatatcctccagttcgcttgcttcctctatatccaaacgcttcgttaggaatatcgatccctgtctttactcccaagcctaattctccaagatctcttcttaaggtttcaaaagcttcatcattgatctttagcggtccatcatatacgtagtttgctcctcctaacagcatcgctattctaaacatataaacatttgatgagtatgctagagcatctatttcattgatcagtcctaaatttcgatgtgatttcttctctttcgttcctttgatcttgattggttcatccataaaggtcgtccctggtgttatcaccccttctttaaacgctgtataaagagttcctcctttgatcgtcgatccaatcaaattggcatctaaatagtttccagctgcataatctgttacttctccggtctctttattgatgatctttccagacatcacaatgatttcaccagtgtagggatccatcagtgtaaaaaacatcttattaaagaatttattttgactgttcatcttgaccagttcttcttctattatcgaatcggcaaactgctgcagctcccaatcaattgatagacggatatttgatccggctgttcctgatttggtacttgtaacaattggatttccactactgtcataattcaatgtatagctgctgtcgcttcctctcaagatattttcgtactgtgcttctaatccagataccccgactctggaatcgttttgatatcctaaagctaacagttcatttttcatttccgaaggcagaccctgttttttcgttgttactctgcccagtacctgactgaattcccggtcgtaaacatactgccgtgaccagtctgtcgttacatcgattcctggcaggatatcgatgttttctccaataatacttgcttcttcttcactgatcccttctgctagtactgatgatccgcttgaacagctcttcatcaaataataaaagtgcgtatattttaatgtgttttcatccatatattcctcaagcatctcatcagtgattcgttcgatctgaagatttaataaagcactgtcataattattctgctctttaagtttagctttttcttcatcactgactaattcatcagctagatctggatatgcaataatgaaataatcttttttattacgggttgaaatagaagaggtatctagatttatcgtcttcgctaaaaatttagccgatgtttttaattgttcatccttgatctttttaggtgcataataagttgcacagataacattagtattttgtaccagtttaacataattacgatcgacgatctcacctctaggggcatcggttgaatatgtagcagtaccatatttttctaatttaacagctaattcatcgctgtctttaaactgaatcaaagctagtctagcagccatgactgatgtaatagcaataatgaaacaaagcaaaacgatcaaccgcctgctgactatattatcctgtttatttttctgttctcgttcttgttctaaggctccataaaaacgaactttatgaattttatttttaaaattaaatgccatcttattgcctccttattattttaattattatagactaattatttgttcaagtaaatcaaaacagaaatttaccacaaaataaagaaagtacccaaaatcactttttataaaataataaaaataagtagtacatgcatactacttatcatcatcgactgacaatattgccatgaaagcttcttgcggaatttctacatttccgactgctttcattctctttttaccctctttttgcttttctaataatttctttttacgggtaatatcgccaccataacatttagcaagaacgtttttacgcattgctttgatcgtagttcttgcaatgatctttccttgtaaagctgcctgaattggtacttcaaacatttgtttaggaatgatttctttaagtttttcacaaataacttttcctcgactataagcaaaatctttatgaacgatcgttgaaagtgcatcgacaacttcgccatttaataaaatatccattttttgcagtttactactacgatagccaatcaattcataatccaatgaagcataacctttagtactagatttaagtttatcaaaaaaatcataaactatttctgataatggtatttcataaataatatttcgacgcgtatcgtcaatatattcaatatcaatatattcaccacgtttattttgacaaagttccataatcacaccaacaaattcacttggtgacataatcgaagcttttacatacggttcctcaatatgatcaataacttgtggactaggcatcatcgcaggattatcaactactactttactgcgatcagttaaataacaatgataaataactgatggtgctgtagctattaaatcaagatcaaactctctttctaatctttcttgaattacatccatatgtaacaatcccaaaaatccacatctaaaaccaaagccaagtgcttgtgaagtttcaggttcaaacattaacgaagaatcacttaatcgcattttttctaaagcttctcgcaaatctttataacgagcattatcaattggataaagaccacaataaaccattggatttaattgtcggtaacctggtagctgctgattcgattcattttctaatgtagtaacagtatctccaacatggatatcctgaatagatttaattgacgcacaaaaccagccaacctctccaacaactagctcttctttttttatttctcttggggttctaacccctaattctgtaacttcataggtagcgttagttgctaaaaacttaactgtgtcacctaatttgatttttccctctttgattctaacaaaaacaattactccacgataactatcataataagaatcaaaaattaatgcctgggttggattattgatactccctgatggagctggaaattcttgaacaaccttttcaagaacttcatcaatatttaatcctgtttttgcagaaattaatggcgcatgatcagctggtaaaccgattacgtcctcaacttccctaattactctttgaggatcagcactaggcaaatcaattttgtttataactggaagtatctctagattattatctaaagcaagatatacattagctaaagtttgagcttcaacaccttgtactgcatcaataactaatatagcaccttcgcatgctgctaatgatcgtgacacttcatatgtaaaatccacatgacctggagtatctatcaagtgtaataaatatgtttcaccattttttgcagtataatttaattggactgcatttaactttattgttattcctctttcacgttcaagatccatactatcaagcagctgggctttcatttctctatcagcaacagcgccagttatttgaagaatacgatctgccagggtgcttttaccatgatcgatatgcgcgataattgaaaaatttcttattttactttgatcaatagtcattttcatcacccactttcgttatgatattataacaaataagtctcttaaactcaaatactatttattttcacgaaaatatttgtcaagtaaagaaacatgctcggcaataacttcaattgatgtaataattttagaatcactgcactcaaacgttcgcgaatgtaatcttccttttacagctactaggctgcctggcattgcagtttctattatcatttcagcaataccgcgccacagtgatacagtaacataatcactttcataagcacctaagccatttttaaatccttgttcaatttgaagagttgcatttgcgacttttacacctcctttagttgttttcataaccggtatatctacaagacgacctaccaacattacttgatttaacatctattcccctcctttgcatagcaattataggcggaaagaacatgttttgcaagttgatgatttttaacctaatttagtaaattcctaaaatcggtctgtgatgactatttttttttaaaatttatctaaatccttacttaatatcccaaaatagtccaaagatgtctacaaaaaaaagttgaaaatattatgattttaagactttagttatcctaaaaacaaaaacaaaagaacataaatcattgaaaatctctcttcatatttatgttccttttatttttatcttttcattaaaaactttttcctagttctcttttcttttacgatttgttaaaactgtagccatgcttaacaatcctactcccgcaaataaaccaattaaactatcatcaccagtagctacacttgctgttgtatcaccggcttttactggattacttgcttcatttacttctaatccagccatcgcttttgttaaaacatctttagcattatctacctgttcctgtgttgcttctggatcgtttaatactgctttggcttcatctaatgcttccaccatcactgaccatgtcttagcactgtaatttgtaacatttaatgtttcagctttattgatcaattcttgtaatagatccttatttggaatcaatcttaagtctaagtatgctctgatcaatgcttcatatactgcatctactgcttcttgtgttgcatctgcatcatctaataccgctttagcatttgccatcggctctgctaagttggcaacacttccttctgtatatagactcttatctaagccatttaccatgtcatatgcttcttgtaatcttgttttatcaactctgattactaagttcgtcatagcatcttttaagttatttaaggcttctactacttcatattctaatgcattttcatcattcatgacaacactagcagcatctaaggcttctttgaatactgtccatgaagctggtgtgtagtcttcttctgcataactatttgcttcattgatcaaggcttctaaagcactcttatcaccttttacaaattctaacatatgcatagcaactgataaacgagcaaatgaagcatctactacttcctgactagcactatcatcagctaaaattactgttgcctcttgtagggcggctttaaattcattaacgacagctgggacaacattagctaactgttcatcagttacattatttgccatttcaacagctattgataaagctaatttgtttactatttctccaggttcaggatctttagcaacaggtgttcctataatattagccgtaataccagcacctttactattaactgcccggacatagaaagtatatgctgtattattagttaaatttgtaaaagtataactgttatcaactgtatctacccaagttaaaccatcacatgatacttggtaacctgtaatagcattacctccattagttttaggcacatcccatgataaagtcacagtttgattaccagaaacgacagaaagattttgtggttccccaggtgcttcgacgatatcaatatttctgtaaagagagaattgtttaccttcaccatttgaatatccactaaacatccctttactagaatcgcttaactgataattagtagtactgtctgtaaaatataatcctgttaaaccatctgtaattttaattatatgatcagcagaaccatttaaattaacattactattgccaatacttaaaacaccactatcacaacttataacatagctgccatttgatcctgtaaatgtccattcatagctactataatcaccagttaaatgtgcaacatcactagttaatccaatatcttttggaacaagcccagttcttcccccatttgtcattacttcatgagttacagcactgtatttaggtaatgtatctctactatctgtaaagatcataaaatatttattaccactttcaatttgatcaactttatttaccaattcataaacattgctattagctgtatcaatagcagttgcactatacgacgttgatgtagtagtagaatcatttccatctgttacagttaaattaattgttgcacttccttctccaacagcataaactactgcattatcaccattgccttcaactgataaaatatcagaattactgcttgaccaatcaaatattggatcagttatattagaaatttctgctgttaatgcagctgctccgccaactgggataatatttttcccctcatttacaatcttaacagctgacatggctttaactgtattaagttcaagatttccaggaccggtaacaactcgggtatctacatcataaccactttcattcttataagcgtttcgtactccttcgcttttaagattatatgtaccatttgcactataacgatttatctctacacgattttcataaattgtaaatactgtagaagtaagtgtagcttcaaccccactattaacttgattataataacctgtgtatccaggattcatataagtaaagtttaaagtttctgctttgaattctgtacgacttgattgagcaatattaatactatcacctttagcaagatatatacaagaaccaccaagataatcatcccaaccatttgaatgatcatgaccaaacaagaaaataatatttaaaccattagcacctgcttcgttaagtacatcaaacaataaattggcatattgagtatcaccgtcattacgagtacgcatactataatgcaatggcaaatgtgatactacaaagattggcttactataaccttctataagcttatcaccaagataattttctagattattagcagttttttcaatcgttccacgatcactattataccacatataatcaccttcgttgataacaaacaccccataatcctcagtatcgttagcaccacttggagtaattcctggagtgctggcaggatcatgatttccctgaacaaataccatattatcctcactgagtgatggccattttgaattaaatacattcttgatagaaattataccatgtgatgtatcactaggcatattgtagtcataatctccggcatataaagccccatctacgcttgtatgaccatcatttatcatagcatcgatgatagcgccaagtatttcttcaccttcagcatcaccggtttttgcctgataatctgaagctgcaaagacttttgttattggtgtatcagcaaataccggcataacagtacttacgcaaagcatgaagactagagcaatagatgtaagaaatctaaacctattatgtttcataaattatacttttggtatattttgtatacctttccctttctctaaattttaattacattataaaagtgatgtatatgatttgtttctattgttcgttttaatagcaataaaaaaatcaataattcaaattttcatcaattcttgatatcttgctggttattgcctcttaataaaaatatacatttttcctcttttacccaaaataaaaaacaactaatcttttagcaatattctataaataaaaatatattagtattctattaacagaaataaaagaaaacagttaattaataattaaaacttaatcaatagtgtggataacaaaaagagtcacctcctaaaactagctctcttattttaatatattttttatgcataataacttaaatatggcactctaaaaattctatcaaaaataaaaactacattatcttactttcaataaatattctatctaatacttgtataagagagttacttgagtaacttttaaccgaaaacatttttatttagtacaatagtgattttattaaataaaaactactaaacttgttttcagtatacattttcattcacttttcaaagaactataatacctgtcaattattcttcaatataattagacctttacaaagaatcagtgtcaaaaagttaatttattataatttctatattttatataattattatcccatttacattttcctgctattttgattgattcactaaaaatctttttcatacaaaaaaagtaacagttccactaattgaggttgcaaaacaacaaggatctattactatcattaagtttaatcattatttatcaattttaaattaatctcataaataattacactattaaaaatcatctttcatttaaaattaaaaatttgctttttaaatctaaacttttagaatatgcactttttttgacagaaatactaataattaaaatgaagaaccagcatcttcatttattccattgtagtattattttcaaaaaaatacacatcttcatacataagctccccgtatagaattaaattttttaaaccatcaacactatttatatattaactatataccccaaaacaaaatccacacatttgtaagcggtaccataatatatactaatattatagcattcaaacttttttttagcaacaaaaaaagtatagttcctaaaaataacataaaaaatttggtatataaataaaaataacctgtattcaggttatttacataagtatatatcaataataatcaagcttctacaactacataagcgatggcataatcattttcatgagcaatcgaaataaaagaattgggataattaagatatggcttccctttagcatcatttaatatctcaatgtcacaaaaagtatccaaaccctgatcaattcctacagctttaaaaaatgcttcttttccagcaaaacgtcctcctaaaaactcacgcttttgcttagatgtttttttattttcatatatttttagttcttttgcagttaaaatcttattagccaatttatcatttatccgatttaaatcaacaatatcgcaaccaatacccttaatcatttttaatccttaaattttttttcatacaaactcatcaattcatctaaagacatatcatcatcaatttcatcaattaaagaattttgtttttcaagttcattagtactaaaatcaagtttaaactccccagttctttcttcgataatttttaactgatctttttcctcttcaactattttagctatatttcgtaagttttcctccactgttggtaacttttcaatttctttagatttcttttttttcgctttttcttcattgattgaagttaattttgcttctgattcaacaactggtttttcttcataattaccaaaatatggacttaaaacaggcactaactggtcgttattctttttcttctttggtttaacagtttttttcgttttaacagttttttcttcttcttttctttttgtaataccattcattggtgaaatgacttcgctcatttgataaacaggtttaggcttttcttcaactaccggttttgtttcaacagtttttgattttgctttaggtttagctacaggtttttcttcagcttcgctaacttcttctttaaactcttcatcataaatcaatggcgtactaaacttttcttttcgacgctgttcaacaactggatcgacttcaaaaatatcatcatcctgctcatgttttttaaataaacctctaaacatacttaccctccttttctagaaaaaagaatctccgatatcatacttatctttgtctaatacaagaataccacgaacttgaggagcatttggtaaacctaactcacgtgcagaacaaatcattccatttgaatctactttgcgcaattttgatggtttgattattaaaccgctgggcatgactgcacccactgtcgcaacaacaactctttgtcctgcttcaacatttggagccccacaaacgatctgtgtctttgtatcctttaaatccacctgacaaatatgcaaatgatctgaatcagggtgatcgcacattgaaatgatttctccaacgataaaacgtggagttttatctaagactactggttctaattcatatttatttaaaagttgattaaaagcctctatctgtgcatcattaaatttgatcaatccatcattaatttctcctaaatatttactggcatttaataaattataaccaataactttatcctttttatctttcaaaacaactaggtcatcatatttatcataactgaatgtcttgccttcattacatctagctaacattatatcaccgatatgaccatgattataaaatccatgaaataacatctctacacctcttactttaaactatctataaatgtttgaatttcttctttagttttgcgaagtttacttacaaagcgtccaatttctttatcatcttcatatcctacaaaagaaggaattcctaaaatatctaaatctttacataaatctaataaattatcacgatttattaaataaaatttaaattctggattagcatcaacaatatcgccaataaaaggtttaacaaacatacaatctggacaccagtcagctgtaaacatgataattgttttacccactctaactttgtcaaattcttcaagtgttttaatttcaattaacttatccattttctcgatacctcgcaaccaatttataaattgggcctttcttacaaaatttacgttcatattcagtcataatattagtttcattttcaggactgtgatgcaaatcaagatttacagtttctaaatctaatggatactgattcaatgaaactaaagaatattcaaacagaccacgattatctgttttaaattcaatcacaccatcatttactaatattttatgataaacatctaaaaatttactagaagtcaatcttcttttttcatggcggtttttaggccatggatcactaaaattcaaataaatcttatcaacttcattctcattaaaaacatcacctaataaaattgcatcataacgcattaagcgtagattagtaatttttgtttcctgcatattaattttattaatagcagcagctaatacacttggatatttttcaattccaataaagttgatatttggattacaacgagcattttcataaataaaatcacctttgcccataccaatttcaatataaattggattatcattaccaaaaatttctttccatttatttttaaacttttccggctcgattacaacaaaatcagtattttcattcattatatcataagcctttggattatttctaagtcgcattactactcccctttacatatatgcatattctatcataaatcattcatcaagtcgaccaattcctcatcagtaagttcacgaaaatcacctaattctaaactacgatctaatgataaatctttaatttttaagcgcttcaaatatgttacatgtttgccacaggcttcaaccatctttttcacctgatgaaatttgccctcaaaaatttcaatttgtaccttacaaaaagcttcaccagtttctagtatttgtaaattagcttttttacatttataaccattatctaaaacaattccttctttaaaagcagcaatatcattttcattcatgattccttcaacttcagctatatatattttagaatgatttcgactaggtgccatcaatttatgagcaaaatcaccatcattgcttattaacaacaaaccttctgtatcaatatctaatcttccaactggaaataaatcataattttcataaccaatgattaaatctattacagtaggatgaacattatctttggtagcactaatatatccttgtggtttattaagcattatatatacataaggccgataattgaccttttcaccatcaaaaacaattatatctttttcataatcaactttataatcatctttttttattatttctccatttactgtaacatatccttttctaataaaagctttgacctcttttctagttcccattccataattagctaacaatttatctaatcgcattaccatataatcttataaacctctcttctttttctttaccattttcatcgttataaaaagttaaataaactaatacattaaactcttttttagtcgtgatcccagataaatttacacctttataaattcctttttctttatctataacattagggacgagtgaaaatacatcatcttcaagaattcctaaattaggtaaactcgcactttcatcttgttcaacttttgcgattgcttgtaaatgatacatatttattttaggactgtcaataacaacatcatagcgatttgtctcatcatctattttattgataattaatctgattgaaaactcatcactaccatcctgatagtttttagactcattgagcatctcttcatatattttatattgtttatataatttatcatttttatcatcgtctaagctattattaaaacagcctgtcaacaatatactacatataataataaaaacaattcttttcatattcttcaccgtaaccattatagcactttttataaaacaataaaataaataggaaccgaagttcctatctacatttaaaagtttcacaagcagtttctttaacttcttttgcttcattacatctacaattacatactgtaatttcttgggcatcacacttacaattatgattgtatacacaattgtcaacatgacaacatacatcttttgccatggaatcacctccattactagttttagcagttttaaagaaactattcaaaaaaaggataaataattatttatcctcatattcgatcaaacagctaaaactatattctagctcactagaaaaagtcattgctacttgataatgaattgctaagattttaggatcttttttagcgataaattcattgatttcatcttctaaatctaattcatgagttttttcaattatttttattttcataattagattataatttgtagatcataaaatttttgtcattattggttgatttcaatttttaatgctgcttcaaatacttcattaggttttaaagcgataattccttctttatctttaaattccccagtaaaatcgacatagtcactatgtccaaaccaaggttcgattgcaacaagtccacctacatgtttagctgcccatattcctaagtgtttaaaaccgtccatatgaactaccagtgatttatcatgattcaaagattttaatgcaatttttttagatttaaaattttctaagatgatcgtatcattactgaacaatttttgacgaataaaaaatcttctttcattatctaaaaaactttctgtttcatgagtgattccctttttttcaagattcaaaattttacgtgccaaagtttcattttcactaaattccaaataataatcgttactagattcattttccataaatggacaagcaaatgctggatgtcccccaatttgaaaatatatttctttttcatcaatatttgttactttaaaattacatgttaaaatattctcatttaaagtataaataacatctaatttaaataaatatggatattgtttaatgatctcttcatttgatgtgagtgtaaacactacttcctggtcactaatttgatttgcctgatattcattatgacgtgaaaaaccatgttgcgtcatactgtatgtcttaccatcgatacgacattcattattttgtaaagcgccaactatcggaaataaaactggtgcactactcccccattgaatcggatcacgacgccacatataatttatttgatctttttgaccaataattttaataatttcagcacctttattagctaattgtacttctaaaaaatcattttttaatgtaatcattttctttacctgcatacctttccaaaataatatatcttaaattatttcttttcaaattctaataaaatcaaacaattatacactacatcagttaaatcagagatgatttcaccatcagcagttcttttttcttttacaacacagtaattcaaacgaacttttacttctactacatcattaacagccagtttttccaaccagtcagcattttctccatcagcataaatatatgatgtttctcttccaatattttcattagtttcaaaatcaagaatatttacttctcgaccgattgtatcaccaattgttagacctatggaatttacaatttcactttttacggtaaatggttcatcaaccatttgcaattttatttttccttctttaccagcatgttttttagggcgaagataaaattcattaatgatctctttatttaaattttcactttttatttcaaattcacggtttctttcgatatcaaatttaattttttcctctaatccgcttaaagtatctaccagatctctactaactttatctcttaaatcctcaggtgtagtaaaaaaactaacagtatgtatttttttcaatttttctttaaaagcttttaatttttctgctttaattccggtatcaacaaatttaggaggaattggatgattatcatccaaaatataaactagagtaggaacgttattttttatagcctcattatattctagttctgaataggaaagatcaaactcttcatgaactgaaccataacgcatagcaatgattgaaataaatactttactttctcttacctgagataaacaggttgctagcgaattacttggactagaaccaaaatattccattccttttactatttgttctaatctaacgataacttctttaacttgatcacgatatggaatcaaatcttcgtaggttgatgaaacaaaaatgggtatatgctgtttcaaaattacatttgccatagttttcccctttctttaatattttaattatatcatttaaaagattttactacaacaaacaaaaaaggttttgatcttttagtttcactgaactaataaatcaaaaccttaaaaattattcaccatgatgatttagatcatctattatcttttcaatcttatttccatactctaaagaagtatcgttgacaaaatataattcaggcactttacgaatagtaagacgcttagcaagcaatgaacgaataaacccttttgaacgctctaatgcctgcattcccttacgtgtatcaaaatctttacctaaaaaagttacataaattttagcaatcgataaatcattagtcaaatcaactgctgtgatcgtacaaaaaccaattttaggatcacgtacttctgtttgaaggatctgtgataattctctttgaataataccactaactttttctttctttaaagccatttaatcacctacttaatttctacttcttccatgatatagccttcaacaatatcgccttctttaatatcattaaagttttcaatacttaaaccacattcaaaaccactggcaacttcttttacatcatcttggaaacgtttcaatgatcctaatttaccttcatatacaacaacaccatcacgaagtaagcgtactccacaattacgacgaataaatccatcagtaacatagcatccagcaatattaccaactttggaaactttaataatttgacgaatttcagcttgtccagtaactacttctttcacttcaggcgcaagcattcctttcatcgctgtttcgatttcttcaaccatcttataaataatattatgcaaacggatctcaatgccttcctcttctgctttttgccgaactttagcattaggacgaacattaaaaccataaataattgctttagatgctgtcgctaataatacatcagattccgaaattccacctgctgttgaacgaattacattaactcttacaccatcaacatttattttttcaagtgaagctttgactgcttcagctgttccttgaacatcagctttaacaataatatttaaatcaatgacctcaccatctttgatttgtgaaaataaatcatcaagtgataaagctgctcccgtactacgttccttatcctgtttagctttcaaacgtgattctccaacactacgtgcctgtttttcagtttcaaaagccataaatttatcgccagctacaggtacttcatttaatcctgtaatttctacaggtgttgctggtaaagcttctttaataattttaccacgatcatctaacatttgacgaacgcgaccaaatgccgtaccaacaacgatgggatcaccggctcttaatgttccattttcaactaataaagttgctactggtccacgtcccttatctaatttaccctcaacgacactaccgtatgcataacgattaggattagcttttaaatctgccaattccgcaactacagttaaagtttctaataattcttcgattccgattccctttttagctgagatttcacaatacacagtatctccaccccagtcttcaggtaaaagaccatattcagacatttctcctttgattctttcaggatcagcaccttctttatcgatcttattaacggcaacaacgattggaaccccagctgctttagcatgatcgatagcttctttagtttgtggcataacaccatcatcagcagcaacaacaataattacaatatccgttacctgggccccacgagctctcattgctgtaaaagcttcatgacctggagtgtctaaaaaagttactttttttccatttacatcaacctggtaagcaccaatgtgctgagtaattccaccaaattctccttcaacaacagcagattttctaattgtatctaataatgttgtttttccatgatcaacatgtcccattattgtaaccactggacaacgtggtactaagtctttttcatcatctacgatatcgatttcttcaaaattaacttcacttacttcaacatgtttttcagcttcaaaaccgtattctaaacatattaattcaacttgttcatcattcaatgaagaattgatcgtcaccatcgttcctaataaaaataatactttaataacattagcaggtgtttgaccaattttttctgctaattgtccaactgtgattccttcttcatatacaattactccatctttaactatttcttctttcttagtaggaaaattagatttcaattgtttcttttttgatgcaccctttttattttttgaatgtttattttgttttaccataacttcaccctcctatcttttcttttaaatttttagcaaatcctctatctgtaattcctaatgcgacacgattatttttaccgattgctttagaaagttcactaatgttaccagcaataacataatcaacattataactagtacatttatctgtaatcttcttcttactattatcacttgcatcactagcaataactacgaaatataccccattagatctaattttatttattaatgtttctcctgtaacgattttacgagcccgactagctagacctaaggtatttaaaaaattattcatttgcatatttttccaattcttcaaaaatctgctcaggaatttcaacttgtaaagctcgggctaaaacttttttcttttttgccgtttcaaaagctgccttacttctttttaaatacgcaccacgaccattcatctttcccgtcggatcaacgaatacttcgccttccttattacgaacgacccttatcatttctttttttggcaactgttctccagtagccaaacattttctcaatggtattttacgcaagatcatcactccttaatcagcatcataatatttatcatattcatcataatcgatttcttcatcatacttattgtaatcatcatctaaatcttcaaaatcttcatattcaaagacttttttaactggtgtcacttcaactgcttctgtttcatcatcttcaattgcttcagctgctgtcttttctaacatttcttgagcgaattcttcttcaaagccagtatcaacaggtgaatcttttggttcattatcaatttcatctaatgtcactaaaccaagttctaaagcttcactgactgatttgatatcgatcttccatcccgtaagacgtactgctaaacgggcattttgaccacgtttaccgattgctaaagacaactgatcatcaggtacgattactaaagcactatgatcatcttcattaacagtaacatatttaacatcagatggacttaaagcatttgaaataaagacaactggatcactactccaaataataatatcgatcatttcaccatttaattcatcaacgacatttttaactcggctgcctttaggtcccacacatgaaccaattggatcaacattttcatggctagtataaacagctactttacttctttctccaggttcccgagaaaccgccttgatttcaacgattccctcatatacttcaggtacttctagttcaaataaacgcttaacaaaattcggttcggttctactaacgacaatatgagttccttttgtaccacgatcaacatcattaacatagacctttagatgttgtccttctttgatcttttcaccagggatttgttgatttattgctaaaaaagctccagttttaccaatattgataattgcaaacttatcttctacccgatcaacgattcccgtaataatatcatcttttttatctgcaaattcattataaagtgtttctttttcagtttcgcgaattttttgtctaaacagctgtttagtttgaattgctgctaaacgcccaatatgttcaacatcagcttctgtttcaacaacatctcctactttataaaaaggattgatagcttgagcttcttctaaagataattcaatatcttcatcttcaagatcttcaactaccgttcttaattcaaatagtctaaacttacccgttttttcattaatttcaacacggacattagcatcaggatttaaataatttttcttgtatgcttttgcaattgattcttttaacatatctaagaaaacttctttttcaattcctttttcttcaattaatagatttaatgcgtccatgaattttttacttgccacttttttttcctcctaaaatttcacagctagtctaataaatttaatattgttatagtcaatcttaatctttttcttaatatttttgaccaaatattcaaattcaatcacttcatcttcaattgtcttaatataaccttcaacttcatccatccccgcaatcggatcataaaatttagcataaacatatttaccgatcgattttttaacctgttcaaatgtttttaacggtttttcaattcccggtgaagaaacttccaaataatattctccttgaatcggatcttcttcatcgagtttctggctaatcgcttcacttacagctacacaagtatccatatctaaaaatccttcatttttttcaataaagattctaagataccactcccctttatcttgaacatattcaatatcatcaagataaacatcgttactttgtaaaattggttcaatcatcattttaatcttatccaaaagttccatcatttcacctctattcaataataaagagtgggttgccccactcgcttcctatgaaactgtctatataatagcacattttaatttatattgcaaccttttaaaaaagtgataattgatttctttcctgcatcccattaaatacacccatttttgtaagtgtcttaatatgtgaattgtttaatttagttcgtttgataacatcttcttttgacaaaaacggccctttttcacgcgcttcaataacagttttagctaccgcatcacctaaagcatcaatagcactaaatgggggaatcaaagcatgatcatcattaggatcaagaataaacttactcgcttgtgaatattccaaactgattggactaaaatggaaccctcgttcaatcatctctaaagcaatttcaaatacatcccataatccctcatctttatttgaagcacttcgctcagctcgaagccgcgtaatttcttcacgtcttgccatgatggcatcttttccttggatcaaggtatctatttcataaaaatcacatcttgtcgaaaaataaactgcataatattcgcgaggataataaactttccaccaggctactcgaatcgctgaaagaacataagccactgcatgggctttgggaaacatgtacttgatttttttacatgaatcaatataccactgtggtacgttatattttttcattaattcttcatactttttctccggaaaaacggctggtgattttcccttacgaacacattccataatatcaaatgcatctttatttggtaagcccttttcaatcaaataaaccatgatatcatcacgacatccgattacttccgaaagcgtacaagttcctgatttaattaaactttccgcattgcccaaataaacatccgtaccatgagataatcctgaaatgataactagatcactaaatgacttaggctgcgtttgatccagcatgccgcgaacaaaagtcgttccaaactcgggtaagcccagcgcaccatttttacaaccaataaagtctagattacagcctaaagcttcactactagtaaataaagacattacttttttatcattcgtgggaatcgtcttaggatcgactccggttagatcttgtaaagctctagtaaccgtaggatcgacatgccctaaaatatcaaattttaagacattgtcatgaatcgcatggaaatcgaagtgtgtcgttttccataccgctgttagatcgtcggcaggatattggtaaggagtaaaatcaaaaacatccatatcccgaggaatgacaattattcccccaggatgctgtcccgttgttcgcttaacaccaccacagccagctgcgattctctctaattcagcacttctgatcgtttgatcagtccccattaattcagcatagcccttggcataaccataagcagttttttccgctactgtcgaaattgttccggctctaaagacatgatcttcaccgaagatttctttagtaaaagcatgggcattagcttgatattcacctgagaaattaagatcgatatccggtactttatcagcattaaaaccaaggaaggtttcaaaaggaatattgtgtccttcgcctttcattatctttccgcatttaggacaaaccttatcttcaagatcataaccatcggcaataacaccttcatctaaaaattcactataagaacaattcaaacaaacataatgtggcggtaacggattaacctcggtaattcctgacattgtggctacaaaagaagatcctaccgatccccttgaaccaaccagatatccatcatcattagatttctttactaataaatgggaaatataataaatgaccccaaaaccatgtttgatgatgttacttaattctttttctagacgcttttcaacgatttctggtaagggattaccatatgttttataagctgtttcataacaaagttttttcaaattttcatctgcaccatcaatttttggcgtatataatttatcatgtactggtttgatttcttcaatcatatcagcaattttattagtattagttacaacgtattcatatacttcttcttgtggtaaataaggataacattccagcatctcatttgtagttcgtaaatactgagaaggatttttagctttaggattacgacgatcacataagggatgtgctttatgtcctattccgatcgtcgggttagaaataaagacatctctaaaaatcttatctttaagatctaaaaaatgaacatctccggtagcaacgatcagtttatttaattttttagcacaatcgacgatacgatgtaatgacttaattaattcatcacgatcttgaagtttacctcgttcaattaaatgatagtaatcttctaacggctgaatttctatataatcataaaatgccatggccttttctaatttatcatcagaaagatttaaagctgcttcaaaaacatcaccattataacagctgctgccataaatcaaaccttcatgataatattccaaacgctctttaggaatccttgattcaccatgaaaatatttagtattagcttcacttactaatttaaacatgttctttaatcccgttttatttaaagctaacgctgtcatatgataaggataaacaattttataaacatcatcacctgttaattcacataaatccaataaattatattttcccccctgcatgatttgatgaatcatcaaagtaaaaacatcacctaaaacctgagcatcataatcagcacgatgggcaacttcatcatcataattaacccgataagtacgacagacatttcccaatcgatatgatttcattggttttaagatagctcttgctagagctaatgaatcaatgattggattagttatttctggtaaattatttcttcttaaattctcatttaaaaagccaatatcaaaattcgcattatgagcaactaagatacaatcatcaaaaaattctaaaatatccggtaaaatggcatcaatagtaggttcatttttaaccatatcattagtaatattagtaagattagtaattctagaagaaattatcttgccaggattaataaatctttgcatccggtcgatgacctcaccatttctaatttttacagcaccaaattccgttatgccatcatgaataactgaaagaccagttgtttctaagtcaaatgatacatatgtggcgcgttcaattgaagtatcgattggattatagacaatatttaaagttggatcgatcatattgaactctaccccatagatcattttgatacccgctttcaaactagccatttgagcctcaggaaaagattgaacatttccatgatctgtcactgctatagccttatgtccccatgatgctgccgtatttatatattgactgatcgttccaataccatccattgctgacatttttgaatgtgtatgtaattcaactcgttttgtctcacatgtatcctttcttgcggcaggacttttaattacttcaacttcacgcgccatcaatactgtttcatgggcaaaactatcaaaacgtgcttcaccgcgcactttgacccaaacattccctttaccaattacttttaactcttcaagggaattattagaattattttcaaaccttttaacgataatagaatctgtataatcagttacccaaagactttgaatatgctttccggctctggttttaaccatatccgttttaaatacatatcccttgatcacgatattattctccatcgtttgattagttatttcttctatcttcatttcaatgacattacctttttgacggtaattgtttttataattattttcctgaacaggtggtttttcgtttttttgtaataatgacatatctatttctactggttcataagcttccatttcttctttgatatctttgaaaatatcattattttcatcgatataaaaatcaaatggtctatcgataccaactcccgcaaaaagagtttcaatttgactttttaattgggatagttgttctagctggatttcgttacaagtctctatttttataattgatccaattttaaaactatctattgttaaagttgaacaaactggatattcttgtttcaatttttctaaaagatatcctacatatggtaataattgctcaaccgtaaaatcagtattttcataattgatgcgatattttacaggatagggaaaattttgagctccctgcaacaacaactgatattcatcaaatggtattagctgcggatatgataaatagaacgtataactatcatccttaccaaccactactttcgatataagacctttttttaaaaactgtacttgttcatcaatctttaaattctttaataatattaatagtctatcctccatcatctcacctcatcgatctttaaattcatatttgttattataacataagaaaagggaattaatttccctttaactaaatattcccgaaatatcattgatcgttacaaaaatcatcaaaccaaaaacaaataataaaccaataacttgaagcacatatttaagcttgattggcagttcacgaccaatgatcttttctactaatgcaaaaagcacttgacatccatctaaaccaggaatcggaagtaaattaaacatcccaatattggttgaaaaaagcgctagtaaaatgagaagctgactgatcgaacctgtttgggtaatttctgaagtaacattgtatataccaacaggacctgataactgccctattgtattagccgaatcagttattaatttccctaaagtagtaaaaatcaacaatgccattgttttaaattgatccaaaccatagttgattgcttcaaaaaaacttaatcttcttgtcgcagctttaattcccataatataagaattagtatcctggtcataattagcactaacattcttggtcattgtcttaccattacgaacgatctcaacttttaatgaaacttgactgctgtcagatttcaaattagaattatctaatactttttgaatatcactaaacgaagcaacaatattttcttgatcattataagttatcttagaaatagtatcgccggcttctaagcctgccatcatagctggactatctggaacaaccgtaccaatttctgaggtgttagtttgaacattgataaaacaatatacactaattaaaataactaatgataaaacaaaattcatgaagacgccagctaaaaagacaacacatttcttccaacagctaattccttttaaagttctttcaaaaggaacatctttaaattcctcaatatcattatctgcttctccagccatactaacaaaaccgccaattggcaaagctctaatttcatattcagtttccccaacttttcgtgagaacaatttaggccccataccaattgaaaattcgctacaatatacaccaaatgattttgctgttaaaaagtgtcctaattcgtggactaaaacaacaattcctaatatcaatataaaaacaacaatatttattaatgtttgcatccatcttctcctatctcttttaatacaaaatcacgagcccaagcatcaacttcaattaactgctgtaaagttggctctttaatagtttgatggtaagataaagctttttcgactaattcttcaatttgtaaaaactcaattttaccatttctaaacaattcattggcttgttcatttgcaccatttaaaacacatggtttactaccaccttcacgccctgcctgatatgctaatgctaaagctctaaagcgtttaaaatcaggttttttaaacgttaaagcagcaatcttagctaaatctaaactcgcaccaccagctaagacatcacgttcaggataagttaaagcatattgaatcggtagacgcatatcaggattacctagttgtccaatgactgatgtatcaacaaattcaaccattgaatgaatgatactttcaggatgaatcagtacttctatttgatcataactaacatcaaaaagccatttagcttcaataacttccaaacctttattaaaaagagtagcactatcaatagttattttagctcccatcgaccaattaggatgattcaaagcttcctgtacacttacacctacaagctcttcgcgacttttatcgcgaaaactgccaccactagcagttaaaataatcttttttatctgctttctattttctccatttaaagattgaaaaatagctgaatgttcactatcaactggtaacaatttaacattattttcttttaccagcttagtaattatatgccctgcaactactaatgtttccttattagctaaagcaatatctttcttagctttgattgcttcaattgttggtaataaaccggcaaagccaacgattgcatttaaaacaatatcgacttcactcaatgttgctattttaatcaatccctcggttccatgataaatatatttatggggatattttttttgtaaataagtggcatcttctttattaaccacacaaatatattcaacatcgatcatctctaaaatctcttctacttttgcaatattgaatcctgctgacattgccttgatcttaaacctgtcagaatgatttttgaccacatcaacagtctgcattccaattgatcctgttactcctaagactgtaatatttttcattttataacctcaccatcactaaaaagaaacttaacacaagtgcattaaataaaatactgtcaattcgatctaaaataccaccatgcccaggtaataaatttgaatagtctttaacgccaaaatgacgtttcacagcactaaaaactaaatcaccgatttggcttgtaagagttaaaacaaaacatgctacgatcaaaattgaatttgtttttaaaagtccaaaatacccagcaaaactaactgccagcaaagttcctaaaaacaccccgcctatcgatccttcaacagttttctttggtgatagtctaggaattagtttatgttttccaaaaaagacacccgcaaaataagctcccgtatcactaccataagtagctaaagccaataataataaatactgaaaaccataaacatcacgaagtgacatcaatgcatgtaagccggcacaaatcagtacccccatcgtaaaaatataacttgttctttcaatcgttaaagtctcatcaaatatcgttgctgcaaataagacaaccaaatacagcagtatcccataagaagccaaaaacaaatcattttgatcaaataaaaaaccataactaaaaaataaaaatactaagggataaatatataatttaattttaggacgagtacaaatatgaagcatttcataaaccgacagagctagtactacacctactagtcccttaaaaaagtaaccacctaaaataacacatggcaaagctactatcaataaacaaatagccgtaattattctttgtttcattattttaatcctccaaaacgccgatctcgattttgatacagccaaatcgctttacacaattcttcttcattgaaatctggccataatacatctgtaaaaacaaattcggcataagctaattgccataatagaaagttagacaaacgctgttcaccactcgttctaaccatcaaatcaacatctggtaaatctttagtcattaattcaccagcaaatagctgttcatcaatatcattaatatcgatctcaccctcttttagtttgatagcaatattcttactagcattaactatctcatcacgtccaccataaataaaggcaaaacataatttcaaaccggtgttatgctgtgttttttcaattgctttattaatgatatcctgagtttcttgaggcgccatatctaaatgaccgatcgtacagatcttaacattattttccatcaattctttcatatatgcatcaaaaaaatcttttggcagtttaaaaatatactgaacttcattttcaggacgcgcaaaattttctgttgaaaaagcataaacagtcattgcttctacctttaattcattgcattttaaagcaatatcacgaatcgtcttagttccttcatgatgtccatatgtacgaggcattttgcgtttctttgcccatctgccattgccatccataataaaagcgatatgtttcggaatattattcaaatcaagatcttgataatcttcttcttttttatcttttttaaaaaacatttgttgacctcctgtttaactattcgagattataccataaatagactataaaaaaaagatgctaaatctaaacttagcatcgataattattatacagtcataatctctttttcttttgctttagcaatctcatcaatttctttaacaaatttatcagttaacttttgaactttttcttgaccagattttatttcatcttcactaccgtcaactttttttatttcatcattactatcacgacgaatattacgaactgatactttagcattttcagcatatttccaaacttgtttagcgaattctttacgacgttcttcagttaaagctggtaccatgatacggataagttccccatcattttgtggtgttaatcctaattcagcttcataaataccatgttcaatatctttaatacttgatttatcataaggtttaattactaattgacgtccttctactactgaaattcccgcaatttgattaactggtgtcggtgatccataataattgaccattacacgatcaagcattgctggattagcccgtcctgttctaactgttgttaaatcacgtttaaaagaatcgatcgttttgctcattctttcactcgtatcatctaaaatcatgtttatcatttctattttcctcctgaaataattgttcctattttatcgccattacatgctttagcaatattgccatcttcagacatattaaatacacataaatcaatattattatctttacataaagtaattgcagtttgatccataatttttaaatctttctgtaatacatcaaaatatgaaatgttttcaaaacgttctgcatttggatcaagtttaggatcagctgaataaacaccatcaacaccattttttgccattaaaataacatcagcattgatttcagctgctcttaaagctgctgttgtatcagttgtaaagaacggacttcctgtaccagctccaaaaataacgatacgccctttttccaaatgacgaatcgcccgtcttctaatatatggctcagctacttgacgcatttcaattgctgaaagaactcttgttggaacatcaatagcttctaaagcattttgaactgctaaaccattcataacagttgctaacattcccatgtagtcagcacttgaacgatccattcccatatcggcaccagttttaccacgccacaagtttccaccaccacatactattgcaatttctacaccaatagctttggcatctttgatttgacgtgcaatatctgctacagtctgcgcattgattcccattttatcatcaccagctagagcttcaccgcttaatttcaataatacccgcttatacttcatattaatctccttttttacattttcttaaaaaagatctatgcataaatttgcatcccattatcaacaataatgattactttttctctacaaaatttatcacattttctctctttagtcaaggtagattaatgcctgtaaaactatctagatattttttagatttttctaattataaacaatttattattactcctaataaatgatcaatttaactatattatttacatgatcagttaaaatattagattatgatgtttaccatttcattaaagcataaaaagatctataatctaataagtcacatattttttgaaacaaataattatttgggaaacaactaaaaccatctgtatccaatcaataataaaatatgttatacaaaaaatcactatctatcatctaatgatgatttttgtacacagttttgataatcatgaacagcattatctttctatgattttttaatttaattcctaattcatatttgagattgccaaaagatctaaaatcatctttaattcacttctatgtctgtattaactaatattttattatcctttttctaaagtgtgaatattagtgataacttcttggcttaaaccattccaaaatatatttactaatataaatagtttgctatgatattttactataaatacttctataaatgtatcttgttgataataaattcctttttttattgccatattgttaaatagcttagcttttatatttttctttaaaattgaacatagacatcaaaacaataaagaaaaatcatattttcatcttaatgatatcttatcagcaataaaattattatttcaaaataaaaaagcaaaatatgtattattttttgtatctatactattgatttatgatggtcttttagaaatattattagttatttattctaaacaatttttattattgaatgattttgaatatggctttttaacaacaattcaaggactaggaatgctattaggaacaataagtacaaaatttattgttgaaaaatgttctttagctttaaaaaatcatttatttatatttgaatcattaaaaataatcttgaccattggtttaatttttacaaatcattttatcacattagccagcatattactaattgaaagttttacctgggtagcttgtactatttttgaaagtaccttattacaagaagctttacctgaaggacatcgtgcaaaaattttctcgatttatggatcgatcgcctagatgatgtctatgtggggaaatttagtatttggaaatttatttgaattatatgacttaaaagctgtcgtctttatatctggtgtaatattcttaataattttgattttaatttggaaaaagggaaataaaatttcagataattatatttaaaaaccccgcagaacataaatctacggggtttatttatcattataatagtaactaaaaattaacctttcatctgcgcagctacttcttcagcaaagttttcttctcttttagccattccttcaccaacttggaatctaaccatatttaaaactttaccttcacctaagaatttagctacagtttcatcaggatttttaataaattcttgatcaactaagcacatttcttttaagtttttatttaatctaccttgaaccattttttcaacaatattttctggttttggtttagcagcttttgcattttcttccattgcttgagcttttaatacagctaattcatgatctaatacttcttgaggaatagctgttctatcgatatattgaggatttgaagcagctacatgcatagcaacatcacgagctttttcagcagtagaattagcaactttaacaattgcagtcatttttccacccatatgtgaataagcaccaaatgcttcattatcttctttagttaatacttcaaatcttctaaaacttaatttttcaccaattttaccacttgcttcagcaataactgtttctaattttttaccttcgatttcagtatttaaagcagcttctaaatcagcaggtttattagcaacaacagtttctgcgattgtttttactaacccttggaattcagcattttttgcaacgaaatcagtttctgagtttacttcgacgattgcagcagtattaccttcaacaacaaaagtagttaaaccttcagcagcaatacgatctgcttttttagcagcttttgcgattcctttttctcttaaccagtcgaatgatttttcaatatcaccgtcacaagcttctaatgcttttttgcagtccatcatcccagcaccagttttttcacgtaattcttttactaattttgcactaattgccattttgttatctcctttgtgtgtatttatttaaaaaggaaaagcagagctttcccttattttacaaattatttttcagttccagctgttttttcttctttagttgcttttggagcaccatttcttctaggattaggtctaccacctttatttctaggagctcttctttgattattttcaactgaagtgatagcatcattcatagatacttctttgtcatcttcatctttaatatatgctacagttaatggttcgtttttagcttcacaaatagcatctgccatagctgcaacgattaatttaacagctctgattgcatcatcattagctggaataacataatcaacttcatcaggatcacagttagtatcaacgataccaaatacaggaattcctaagattctagcttcagctactgcattatgttcagcttttggatctactacgaataatgcgtttggtaatcttctcatttctttgataccacctaagttcttttctaacttagcagcttcttttttaagtaagattacttcttttttaggtaataaatcaaaagtaccatcagcttccattttttctaattcaatcaatcttctgattcttttttgaattgttttgaagttagttaaagttcctcctaaccagcgagagtttacatagaaactttcagaacggatagcttcttcttttactgcttcttgagcttgttttttagtaccaacaaataatacttttccaccttttgcagcgatttcattcattgctttataagcatcatcgatttttttagatgatttttgtaaatcaataatgtaaataccatttcttgctgtaaagatgtatggagccattttaggattccatctttttgtttgatgtccaaaatgaacacctacttctaataattttttcattgaaattactgacattgtaacttcctcctttttgttttttcctccattatttcgaacatttatcaccattaggcactagataaatgaatccataatgtgtgtatttttcatacctgagatattttatcacaaaaaaatataacatacaagcatatttttttaattaatccacttttgtaaacatataactaaatttcaacaatctaataacattaaaaataaataatcatgaaacaaatcagcaacaatgttgagacgaataattatttaaactgtgataaaatataaaaaggtagctaccgctgtttgaatggaaggaggaaacgaatgtttaaaattttccagcgggctcatattaaaaataataaagtttccaattatggaatacttgataatattatttctaattttatatctaattaaatctaagcggatttaattagaatgatagcccgtaaaacagtgaaaaggaagagtcacccctcttccttttcttttggaatacttgatttacaactatattttagcttatttttagaaaaaatcaagagtttttttatttatcttcgcttcgtggatgtgtttgcaaatacacttctcttaaatgatcttttgtaatatgggtataaatttgtgttgttgcaagattttcatgacctaaaagctcctgaacagttcgaatatcagcaccagcatttaataaatgggttgcaaatgaatgtctgatcgtatggggatgtattttttttgttggatcataatgtttagtaacacgatcaacaatattttcaacgccacggtttgtcaagggattaccaaacttatttacaaaaacaaaattatgcccttcgtttttgatcattaaattattacgagcatcatcaatatattcaattaaccaatcccgtgcatattcatgaaacgggacataacgatctttatttccttttccatgaattaataatacttgttgatttaaatcaatgtttgagatttgcaaattcactacttctgaacatcttaggcctgaagcatacataagttccagcatagctttattacgtatccctagatcatcttttgtctcaatactatctaataatgcgatgatttcttcaggaaataaaaagtcgggagttcgtttagctactttttgtgattcaatcagcttaaaaggattatctttgattaattcttccttcaacaaataattaaaaaagcttctaagggcacttaatttatgattgatactaacttttgataaattttcttcatacagtttagttaaataacctcttaacataaaataatcaacatcattataactatcgattacttcttgaattaaaaatcttttaaaatgatttatttcacgacgatacgattcaatcgttttatccgaataattacgctgatattttaaataatccaggtattgatcaatcaatttatccaagtccatttatctctataaattccttcattgtttctaatgcccgcgtagcatacgctgcttttcgctccttctttttgatccgaatcgaaaaatctggtaatattccaaaattggctttcattggctggaaatcttcagctgaagcattagtaatataattagctaaagatcccataactgtttctttaggaaaaatcaaaggttctttatcttccaataatctaatcatattaataccagctacgattccactttgggctgattcaacatacccttccacaccagtaatttgaccagccataaaaatactaggctcaacttttaattgatatgtatttaataaatgttttggtgaacagataaaactgtttcgatgcataacaccataacgaacaaaactagcattttcaagtcctggaatcatttgaatgatccgtttttgttccggccatgttaaatgtgtttgaaaacctacgatattatataaacttgcctggacgttatcttgacgtaactgtactacagcatatggccgtttaccatcaggcgtatttaaacccactggtttcatcggaccaaacaataaagtttgtttaccacgtcgcgccatttcctcaaaaggcatacaaccttcaaaaaacttctcttcaaaatctttaggttttaccacttgagcattaatcaactcgtcataaaaatgattaaattcttcttcactcatcggacaattaatatattcattatcacctttatcataacgtgatttataatatgctttttcaaaattgatactttctttactaacgatcggtgctgcagcatcaaaaaaataaaaataatcttctcctaatttatctttaattgcattagacaaggcatcacttgttaaaggacccgaagcaatgatcgtatggccttttggaaactcggtaacttcttcatggataacttcaactaaaggatgatttcttaaatactcagtaatatcttttgaaaaattatcacgatcgactgctaaagctccaccagcaggaacctgatgctttctagcaaatctaataacgatactatcgagcatttccatttctttttttaaaacaccaacagcattagctgttccatcggctcttaatgaattagagcaaactaattcggcaaaattttcactatgatgggccggtgtcatcttttgcgggcgcatttcatataaacgaactttatacccgcgtttaactaactgataacaagcttcgacacctgccaacccagcaccaattacatttattattttttccattttttatcacctttcatattttaacatttattatttgaaaacaaaagtagaacttccgttctactttatgatcgtcttgcatttaggataatttgaacatgctttaaattcaccccagcgtccctgtttgattacaactggtgagccacaatttggacaaatttcatcagtcatgacaggttcttttttcttactatttttaatatacttacattctggataatttgaacaggcttcaaaacgtccataacggccatttttaaaaaccatcttaccgccacattttggacattcttcacccgtatattctatttctacaggatcctttttgatatatttacattctggataattttcacatgctacaaatgtcccataacgacctttgcgctcaactagatcatgtccacattcaggacatttctccccagttttcttaggagcaattacttccattttatcataggcatcatctaataaaggctggaaaatatccataaaactttgcagtgcacttacgtaatcatcttcaccttcagcaatttcatctaattcatgttccattttagcagtgtattcaacatttataatgtcattgaaatattgcgttaaacgatcacttgttaaaattcctgattcggttggtttaaatgctttatcaatcaattctacataacctctagtttgaatcgtatcgatgatcatcgcataagtactaggacgtccaattcctaattcttccatttctttaattaactttgcttcactatatcgagcaggtggtttagtaaaatgttgagttttttcaatcttcttgctttcaatcatttctttttcttttaattctggtaataattcattattttgtttttcataatcaccataaactcgcaaataaccatcaaatttaattactgaaccgctagctctaaattcatatccattattcatcaaagacactgatgtagcatcaaatttagctggtgccatcaatgaagccatcgcccgagcataaatcaaagcatataatttatattcttctggttttaaaaatttctttacactttcaggagttcgtagagcacttgttggtctaattccttcatgagcatcctggacattttctgtctttttactaactttgacttttccaacatagtccttaccatatttttcactaatatactcatgagcactacttacaaaagaatccgataaacgagtcgaatcggtacgcatatacgtaatcaaaccaactgtttcatcctctaaagcaaccccttcatataacttttgggcaatcgacattgttcttcttgctttatagcctaatttagaagaagcctcctgctgtaaagttgatgttataaatggtggttttgactctctttttttggttgtctttttaacattagcaatttcaaattctttatttaatgattcataaatgttatttgcttcttcaccatttttaatttctaatttcttattattatattttgttagttcgccggtaaattcaatttgatctttttcaaattcagctttgattttccaatattcttgaggaacaaatgcttcaatttcacgttctctttcaacgatcaaacgtaaagcaactgattgaacacgtccggcacttttagatttgatcttcttttgtaataacttagataatttaaatccaataattcgatctaaaacccttcttgtctcttgagactttactaaattttgatcgatcttacgtgggtgctttaacgcatcaacaacagcatctttagttacctcattaaatacgacccgattttctttatccatatcaacatttaaaacctgtgctaaatgccaggaaattgcttccccttcgcgatcagggtcggtcgctaaataaacatcatcagattctttgaccaattgcttcaattctttaacaacatctcttttatctttatttattacatatttaggtgcaaaattattttcaacatctacacctaatccctcttttcctgaagtagccaaatcccgaacatgaccttttgaagaagtaaccaaataatcacttcctaaatatttctcaattgttttggattttgatggcgactcgacaataacaacttttttgctcatttcatttcctccacacgaataacacaattattagtgtttttttaacttttgtcaactaaaatttaaaaaaatgtttaatcatcaataatatcattaatatcaactatcaattttgctccttgctggatcaaatgattacaccctaaaggatccgtaattctactagggatacaatatatatctttaccctgttctaaagcgtgccccactgtaatcatcgttccactacgtaaatttgcttctgttactaatatagattcacttaatccagaaattatgcgatttcgccgtggaaaattaactttctttggcaccagatttcctggatattcgctaataatcaactgattacatttcatagcctgataaactgacttgttttttaaaggatagcaataatcaattccacttcccaatactgcaatcgtttgcccaaaactattcatcgcacttttatgagccgtagcatcgattcctagtgccattccacttacgatcgtataattttcttttatcaactgctcaaccatcatttttgtcacctcaataccatattcactaggatgacgcattccgacaaccccaatacacttatttttgaccagctctaaatttccatgatagtataaaacaaaaggtggacagctgatttcttttaaactgatcggataatcttttgatattatggttgtatacttagcttttaaactcttaaataacctttcttttaaaatttcatctactttttctttttgctgtaaagctcgatatatttcatcaaaattaccttcatattttaatgagaaatataacaaaatttcttccataaatttatcacctcattatcttttactccaaaaaaacaaaaattactacaaaaaataaaaaatgtcatttaaaaatcaaatgacatctgtttatttaaaattttttgtactggtgcaaaagatttacgatgaattggacaaacaccatatttctctatcgcctctttatgcatctttgtaacatagcctttatgcttatcaaaaccatattctggataaattttagcatattctttcattaaccgatctcttgtgaccttagctaatatactagctgccccaatagaaatacttttagcatcgcctttgatgatagcttcatgatcagcataatttaggggcattgcatcacttaatgcaaacatcttttcacgttttaaattttcaatacatttttccattcccagcttactagcttgatatacatttaaactatcaacatcctcaacactgataatttcaatatcataagctagagcattttcgacaatcaaatcatacagtgcttcacgttttttttctgaaagctgctttgaatcattaattttttcatcataaaaaccttttggaaagatcaccccagctacaactaattccccagccatagggccacggccagcttcatctagaccaataatataatcatagcccatctgataatatttactttcatactcatagcgattcatctggtttctcccatgtaattcttcccatactgccatcaaatatatcattaaaaaacacttccattacccgatcatagtctgtataaccccgcactggtttaattttacgatttttagctatatcatcatagactttttccacccagtcactatcaaaatcgatttcaatattataacgtttactaaccatttgatagtatgttgtttctaaatatttgactgcataaataaataattcatctaatggtaaaatatcctgtttgattgacccgatcaaagcaatattacgagctgtatttatatcatcaaatcgcggccatagaactcccggtgtatcaaataattcaaaatctttatcaactttgatgatctgttgggctttagttacaccaggacgattacccgtaactgtcgctttacgcttagcaagacgattaataaaagtagatttaccgacattgggaattcctaataccattgcccgcattgctcggggcttaagacctcgcttggcttcacgttccatcttttcttttaaaatatctttgcaaagatcaattattaaatgatattcattgaagtttttcaaatttacacatattgcataaatacctttgtctttaaaatatttgatccacatatcagttattttttcatcagctaaatctctttttgtcataacaattaagcgaggcttattattacagacttgattaaataaaggattctttgatgaaagtggtgctctagcatctactaactcaataacaatatcaatcaatttcattttctcactaatttcccgacgagctttagccatatgtccaggaaaccattgaatttgcttcgacatactttacctcctttaatcaataaacttcatattactaaatggataaatgattactccctttttaccaataatatcactatacttaaaagtccctagtgttcttgaatcagctgaacgtaagcgattatcacctaaaacaaaaatctcatcatcacctaacgctacttcaaaatcatttgtaaatagatcagtagcgtatctttcttttgcctcttcaatataatctttatctaaataatcttctgcataatatgaaccgtttatatataacttatcattactaaaaacaatagtatcaccaggcaacccaattactcttttaataatatctttatctaatttttcacatttcaaaacgacaatatcaaaacgttttatatcatttttgcctaaatacaaggcatttactattgcggtatccttatcgtgtaatgtaggatacatactttccccatctacttttacgggtatcacgatcttcgtaaaaacaactgctgttactgcaacaattgctatcatttcaattgaaaacttaactagttcttttttctttgtcatctgaaggcctcctgcaatagtatcattatacaaaagattataaaaaaaagaaacattagttccaaaaattctattttttaacactttgcagttaaaataatacctattttcacatatttgtaaacattttatcgtaacataaaaagaattctttaaagcttaaatgctttaaagaaatttacttatttatggttctaaatcattattatcctaatctaggttattaataaacatgtattaatactataatatccatatggggtaataaattattgtctcgatatatcttaaacctagatattctttacaatacatcttatgttgatattaaactttagtaaattgctatatttaattttatcagcttcaatttttaatcaaatatccagccagtaaaatcacttttaaatataacttagtacattttgattatgcataagtattaaaaaaaactatgacactgtttttttgtattcttttaatacatgttcatgcattgcttttatatcattagtcataacaacttctactttatgatatatttttaatttttttaattcccgttcgataatttttcttgtcttcttatcaacaaacggaattactattgatgttccatactctctaacatattccaaatccatttcatgtatagttttaataatttcttcttttgttgttgcttttttatatgtaatcatttctttatccccctttagtccaatactaacacaaaattagcattatgtcacttccctatgacactctcttgtcatttttttaactaaaaaataatatttcagtttgtataagctataaatagaagaaatttgatttttttataaattaaaatcaataatactaaaagcattattgattttaaaattattgaattttagataaacctaaaacaattacaccaccaaaaataacagctgctaatgatgtaatgatcaaattaagatcataactaacatcaaaaggaattaatactaatgatgaagcaacgattagaccaagtatcaaacttaaaaatcccgctttatgtgttttagtaaaataagaacataatttagcactgataacaatacctaaagcaattccgattgccataaaaccaagtggcatgatcacatctaaactaaaactagtaacattcgctagataagatttaaataaataatactctcctaaaatcaacaataccatactaccactaacacctggcatgatcatcgtcgctccagaaatagccccaattatcatcatcttaataaacaaaccggcacttaatgctggaaaatcaggattcacaactgttttaccttcaccaggattaaaatattctaaagcaaaaataattgctagaccacaaataaatggaataattgcaaacttttgccctttcatctcaccatttaaaaataaagggatactaaatgcaattagtccgataaaccaatagatcgtctgtgttggataataattaaatagtacttctaaaattttagcaaacccaataattccaacagcagcaccgatcagtacttgaaaaataaaaataatatctctttttcgattaggattttcacgtttaaaaatgccactaatagcatccatcataggattaaaaatacctaaaataaccatcatggttcccccactaacacctgggattacattagcaatacctatggcaataccaccgattatattttttatcatatacttctccttgttatttaatttatccctattataatcaaatcttttagagataacaagagattttattttcttatctcaagaagatatgctatcaattatagtacatacttataaagtaaatatttactttatatttatatagatatcaaaatctaatttccataaaacactcatctttcatttatgatatcttttttttaaataagctatctgctctaaccgtttaatcacttttgcttcagtaccctgattagtagggaaataatagcgttgctctttaagacgatcaggcaaacactgcatatttgttattttatcttcataatcatgagcatactgataccctttaccataatttaattctttcattaatcgtgtcggtgcattacaaagatgtaacggtacagggtcagcaactgtatttaatgcatctttttttgctttttcatatgccatatataaagcattcgatttaggtgctaaagccagataagttacgcaatgagttaaattaacattacattcaggcattccaatataatgacaagcttgatatgcggccgtggctatttctaaagcacgactatcagccattccaatatcttctgatgcaaatcgaatcaaacgtctagctacatataaaggatcttcacctgcttcaagcatcctagccagccaatagattgaagcatcaacatcgctattacgcattgatttatgcaaagcactaataatattatagtgttcttcaccgtttttatcatacaataatgatttttggttgatacattgttcaactgtctcattagtaataaatattttatctttatcgatatttccatttaaaactaccatttctaaagtgtttattgctactcttgcatcaccattagaaaaatttgcaatcatatacaataaatcatcttcaatgattatattttcttctttaaaaccgtttacatcatttaaagcccgatgtaataaatttacgatatcatcgatcgttagtgcttttagtgtaaatactttacaacgcgataataaagctgaattgatctcaaatgatggattttctgttgttgcaccgattaaaataatgcttccttgttcaacatatggtaagaaagcatcttgctgagctttattaaaacgatgaatttcatcgacgaaaacaattgttttttccccttgttcctgcatatccttggcctttttcatgacgtttcgaatatctttgataccactggtaacagcactgaaattgataaaatttgcttttgtttgattggcaatgattcttgcgagagttgttttaccaacaccaggaggaccccaaaaaatcattgaaggcaaagtatcactattgatcaactgatacagaatttttcctggtgcaactaaatgactctgtcctacataatcctctagtgtcttaggtcttaaacgattagctaacggttcattactaatatttgtaaatggcatcttttgtttcatcttctatcacttccattcatctactattatacaatataaaaaagagcaaaatgaataaaaatcatctgctctttcaattattactcagttatcccttcaaattgagattgatataaagaagcatagaaaccatttttctcaattaaagaatcatgattaccaagttcaacaatatcgccatctttcataacgatgatcgtatcagcatcacgaatcgtagataaacgatgggcgatgacaaaacttgttcttccttccattaatttttccattccccgttgaatcaagacttcagttcttgtatcaactgatgaagttgcttcatcaagaatcaagatcttaggatctttcaaaaatgctcgagcaatcgtcaataactgcttttgtccttgagaaatatttgaggattcttcattaatgatcgtatcataaccatcttcaagagtttggacaaaatggtcaacataagcaactttacaagcttctttaacttcttgatcactagcatccagtttaccatacattaagttctctttgattgttccattaaataaccaagtatcctgtaaaaccattccaaataatgatcttaaatctttacgagcaaaatcacgaatatctttaccatcaataaatatagaaccgccattcaactcataaaatctcatcaataacttaacaatcgttgtcttaccagcacctgtagggccaacgatcgctaccgtttgtccagaatgaacatgtaaactaaaatcattaatgatcgtttgatcttttacatatccaaaattaacatccgcaaaagttactgaaccattgattttctttacttcttcacttgttactttcggtgtttctaattctaactcttcttcattcaaaaattcaaaaacacgttctgcagctgcagctgtactttgtaacatattcatcgtttgagctaattgactaattggctgattgaattgacgaacatactgaataaaagcttgaatatcaccgattgtgatattaccaccaccagctaaaacaccacctaataaacaaaccgcaacataaccaacatttccgacaaagtttgtaattggctgcatcaatcctgagaaaaactgtgatttccaggcactttcatataaactatcattaaatgcattaaactgttcaactgaagcctcttcaccattaaaagctttaactacattatgaccaccatacatttcttcgatatgaccatttacatcacctagagcctgctgctgtcttgcaaaatatttttgtgaacgtttcattaccaaagcaatcaaaatcattgaaacaggcaaaacacaaaccgcaatcaatgtcatttgtggtgaaatgctcaacatcataataaagataccaactacagtaacactagaagtgattacctgtgacatactttgatttaatgactgagcaattgtatcaatatcattagtaacacgacttaaaatatcaccacttgtatgtttatcaaaatagcttaatggcattttatccatcttagtagaaatcgacgttcttaagtcataagctactttttgagataccgtagaagtaataaaaccttgaacataactaaataatgcacttaataaatataacccaactaaaatcaagataatatagccgatatattcaaaatcgattccaccagtaccattgaccttagccatgatcccttcacctaatttgtctgttgctttagctaagatttttggtcctacgatcgaaaatactgttgaagccgaagcaaaaattattactactaccaatttaaaatagtatggttttaaatatttaaataacttgctaagtgtccctttaaaatccttagccttttcaccaccacgcattccctgcattcctggtccgaatttaggaccacttcttttttctttactactcatgtcctaattcctcctttgataattgtgaataagctatttcctgatacactttacaatttttcatcaattcactatgtttacctttaccaacgatctttccctcatctaaaactatgatttgatcagctgacatgatcgaagcgatacgttgtccaacgattaaaacagtatttttagttttcttgatcatcttatctaattcgcgacgtaagttagcatctgttttaaaatcaagagctgaaaaactatcatcaaaaataaatatttcaggatttttagcaatagctctagcaattgctagacgctgtttttgtccaccggaaacatttgtaccaccttgagaaatttctgaatcaaggcgctcttctttatgatcaatgaactctttagcttgagcaactttaataacttcttctaactgttcatcagttgcctctggtgctccataagtcagattagatctaatcgttcctgaaaataacaatcctttttgtggaactaaaccaatcttctctcttaaatcatgctgtttaacatcacgaatatcaacaccatcaacttcaatttgtccttcactcacttcatagaatcgtggaatcaaattaatcaatgtacttttccccgaaccagttgaaccaataaaagctgttgtttgccctggtttagctgtaaaactaatattttctaataccgcttcatgagctccaggatatttgaaagtaacatttttaaattcaactaagccacgtttactatcatcaaaagattttggttcttgtggatctacgatctttggttccattgataatacttcataaacacgatcagcagcaacacttgcacgtggtagcatgattgcaatcatggcaatcattaaaaatgacataatgatctgcattgcatattgcataaatgccatcatctgaccaattgcaatatttcctaaatcaatttgtttagcaccataataaacaatcaacaaactaacaacattaaatataaacatcataattggcatcatcgatgccattgtccgattgacgaataaattaacttttgttaaatcaaaatttgctttttcaaatcttttttcactatgttcctcattcccaaatgctctaataaccagcattcctgatagattttcacgcatcgttaaattaagtctatcgatcaatgactgaacaattttaaattttggcattacaattacaaaagtaaccccaattactaaaaagataataattaatactaatccaatgatccatgtcattgatggcgtattttgaaacgctttaatcaatgctccaattcccatcatcggtgcaaagcagacgattctaataaacatgattacaaccatctgaacttgtgtaatatcattggtagttcgcgtaatcaaagaagctgttgaaaacttgttgaattcttcattagaaaaactctcaacttttttgaaaacatcgccacgtaataatcgagacaccccagaaccaactctactagctaaaaatccacaagcaacagcacagacagttcctgctaaagcaatgcctaacattttaagtcctgacattaaaatatactctttttgaacttgatcaacatcacaaccaagttttgtatattctgctttgaccccattaccagcagcaatttttaacgtagattctcccattgcttccatttggctgtcaatttcactaaacatctcagctttttgatcatctggaatcattgccagagcatcgtaaggactcattccttcaggtaaattaccaaatttttcttgatattctttagaacctggatccattgtatctattgatgttactaataacataggtttttcaagaatctgttctaatttatccatatttttatcgttaagatcttttaaagtatagatattttgacctttagcatcaggaaacttatctaaaatgtctttatcaatatctttactagttactaatttataagactgtttgaaaaaatcctggtcatctttatctatcaaaactagtaaatgattatacgtatcttcacttaaaacatcactaacagcactatcaaaaccgcctgcttgaataccaaccgatactatatccgacatataatcaggtaatgctaattctgattgtgattgcaagaacaataagcctacacaaagcaaaatcggtgcccaaaattttttaaaataatattttaattttagcatcatttctctcctttacattcttcaatattctttttcatgatttttatgacatcatttaacacattaatttgttcttttgaaactcctttaaacaaaatcatggttttttctttcataattttagtcgcttgttcaataaaagcttccccagtatctgtaatatttaagacataattacgcttatcgtgttcatcttgaacgcgagtaagataacccaacttttccaaacgctgcaacctaactgataaagtagccttagtgacattgagcttttttgctaaagcattttgattaatattatgatgtttttgtaacatcaaaagtaatttcgtttgattgatcgaaatattaaaacgttctgttttttccatcattgtataatttacagttttatgaaagttttgaaaattatcaaacaattcttttatatcatcaaaattaatctcttccattttctacctccttccatcagttaatactaaccaatagttagtatactaagtattatagttagtacacaaactaatgtcaatagaaaaataaaagatgtcaaaacgacatctaatcaattaaatatttttccaataatctaacaacctcagcaattagatcatcacatgtagcgcgattaacttctttatctgtttttctaattcctaataactcaccacaaataactgaaccatgtgattcttcgaattctttacataaagcagctactttttcattaacaaatttcttttgctttacatcagcttcacctttaccgtattttagacctaatgccatcgcaccaccagtcaaagttccacagatttctctagtcattcctacaccaccaccaaaaccataggcaatgctcatcgcttgatccatatcgatatttaataaatcaacatacgctcctaatacagcctgggcacaattataacccatatgatgtaaatcataagccttttttactctttcttcaatattcataaatttaaaccttaccttcctcattactatctatagtgtagtaatatttggacatgttgtcaagaatcccataattaattttcaagtattaattcagcatataaaagattgtgatctgaaaaagatgacatgatcaatccttgatcatttactgtaaatttattagaataaaagatatcatctggggcagcaaaatcacgaaatgtcatatattctttttcactattaatacttttaataccttcgagttcaaaatcaccattcataccaaaagaattaaaatcaccggctaaaactgcataatcatcaaaatcaactacttctttaacaaaatccatttgtgaaatacgataatcattattttcatatgttaaatgggtattataaacattgatttctttattaccaaaggtaatcgtagttttagttaatattcgtggttctttcaataaactgtttggtaaaagttttgccgatacttcaatgattggatatttactcaagattcctaaaccataatatccatctaagatccacatcgttgaataaaagtgataatacgaatatccattagcttttgccatttcttccagcatgtcataattacctgaacgatatgcatttttatcaacttcttgtaaacaaatgatatcgagatccaatccttcaatatcattattaaaatcttccaaagattcttttccgtaattcaaagattttatattataactgccaattcttaaactatcaaaatcatccgaatttaaattatcatcattagctaaattacattgatactcgcttgcataaacactataataaaaacgtcctacaacaacaaataataaaacgacagtacatatcattagcttcaatatttttttcatttctttcacctaccatacactattatcttctatacttaaatctatatgataaacttaatttacgtcaatatttttgaaataatttgttaatttacgataaattttccgtgatatcacatgaaattacaaagaattttttatatttataaaaaatatccagaatgttttttacatctggatatttttgtagctatttaacgaatctgccctttaccatagatcatatattttgttgatgtcatttcctgtaagccgattggtcctcgagcatgtaatttttgagtacttattcccacttcagccccaaaaccaaattcaccaccatcagtaaatctcgttgaagcattatgatatacacaagctgaatctaaagattccataaaatatttagctgtattttcattttcactaataatactttcagaatgtttagtcgaataattataaatatgttcaattgcctcatcaacgtttttgaccactttgatattacaaatataatcatcgtattcagtagcataatttttagatgttgctaactcgccatcaataaactttaatgcttcagggtcgccataaatcttgatttttgtaaactccggtttcaagcttgtcaaaaaagcattagcaatatcttgatgaactaaaatcgtttcaatcgcattacaaactgaaggtcttgagattttagcattgactgcaatttttacagccatttgcaaatcagcatctttatcgacatataaatgacaaatccctgctccagtttcaattacgggtactgttgcattattaactacatgctgaatcaaccctgctccaccgcgaggtaccacaacatcgacatattgattagctgtaattatctctgtaacgatactgcggtctgtattttcaattaacgttacaacattatcaggtaaaatatctttaattaccatattaataacattaactaaagcaatatttgaatagattgcttccttaccaccttttaaaacacagacgttattagttttgatacagattgaagcaatatcaacagtaacattagggcgcgattcataaattgttgctactaccccgataggaatacgcacttgatcaataactaatccattcggacgtttgatttcacgtactacttcaccaatacagtcttttaaatcagcaactttttcaacatctttggccatcgctttgattctttcttctgttaacagtaaacgatcgaccatcgcctcactaattccattatatttggcatttgcaatatctttagcattttcacctaaaatataatcgatattatctaataatcctttactaatggcatctaaagcatccattttagtatatttatcaatattttgcattttacgacaagctaatttagcatcttttaattgttcttcgatcattattccttcaccccttctaccaagaccagattatttgcatgaataacttcatcatagtctttataatgtaacactttttctatttcacttgtatttaagcctttaatcaacttaatttcatcacttgagtaattaaccattcctcgtgctaataaatcatcattaagatctcttatatcgacgatctgggaaattaaaaaatttcctttcacatctacgattcctttaggtaataaactagtatgcttattgatcaacgccattttagccccatcatcaacaataatactcccttttggcatacttcgatacatgatccaatgctgtcgcgaatttaatcttctgctagcgtcactgttaaaatatgtccctacttctttaccttcgatcaaatctattaaaacatttggttgacccccattaacaattgccatatcacagccaaattcattacatactttagcggctctgatcttggtgatcatcccgcctgttccaactttactcgaagcatctttagccatattttcaatttctttagtaatgccattaacatttctaatcaacttagccttcttattgatatgcggattatcatcatataaaccatcgatatcactaaccagcactagcatatcaccacttacagctggtacgatcagtgatgccaaagtatcattatccccaactttgatctcatcgactgccaaagtatcattttcattaatgattggcacgacatcatactcaattaatgcctgcatcgcatgattgaaattcatcaaccgttttcgatcatcaaaatcatcatgatttaataatatttgagcacactttaaattaaacaaactaaacagatcctcatatatttgcattaatgaggcttgaccaatagctgccagtgcttgttttttcggaattgtctgaggccgctcatcgagtttcattacatgaacgccagcattgattgccccactactaactagtgtaattttgatccccttacgcttaatatatgctatttgttggattaagtttaaaattttttccttatttatatttccctgatcatcacataacgacgaagagccgatcttaataatcaaattttttattttactcaaatctcgcatactaattccccctgcaattattttcttaattatacaagttttatcattacttaacaacaaatattttcttactatataatataatggatttaattaatgttaatttcaataaatataaattgtatgttttaaaaaacatttcctaaatttcatttataaaccttatacgtttataaatacatcttaaaagtttacaaaattactctattttcttattgtatccaagcatttatacatgttacaatgtaaaaaaatattaaaggagagttattactacaatgaaattaattatacctgaaaattatgatcctgttttagacttacgtcaaactcaggaagcaatcaaatatattcgtgatacgttccaaaaagaaatcggaagagctttacagttatctagaatatcagctccattatttgtggaaaaaaatagtggtttaaatgataatttaaatggcgtagaaaatccggtctcatttgaaatcaaagaaatacctgatgaaacaatcgaagtcgttcattctttagctaaatggaaacggatggcccttaaaaaatatggctttaaaatgcatgaaggtttatatacaaatatgaatgccatcagaaaagatgaagctgttgataatcttcactcatactatgttgatcaatgggattgggaaaaaattatttctaaatctgaaagaaacgaagaaacgcttaaacgtcatgttttaaagatttttaaagtaatcaaacacatggagcatgaagtttggtataaatatcctcatgctgttaatcgtttacctgataaaatctatttttttacatcacaagaattagaagatcgttatcctgatctaacaccaactgagcgtgaaacagcaatgtgtaaggaatatggctgcatcttcgttatgggagttggaaagaaattaaaaagtggtattaaacatgatggtcgagcaccagactatgacgattgggatttaaatggtgatatcttattttggtttgaaccacttaaatgtgccttagaaatttcatcaatgggaatcagagttgatgaagatgctttagtagaacagttagaagctgaaaattgtctagaacgtttagaattaccttatcataaacagattcttaataacgaattgccatatactattggtggtggaatcggacaatctcgattatgtatgttattactaaaaaaagctcatgtcggtgaagttcaagctagtatttggcctcaagaagtaatcgatgaatgcgaaaaacataacattcatttactataaaactaaattcttatttattaactataaaatgatatataaaaataaagaaggttatcgctattaataaattcaaatagctataaccttccttttattttatttatttttataataaaaagtttattcaatgaagatttaaaatcttaaagaataaactttttaatttcaaaattatttatttaaatcaatatctgctaaaacattagctaaaccaatataagatgctggtgtcatttcaactaaagtctgacgatcttgatcagataagatatctaaactttctgcaaattttaagatatcttctttagaaatactctttcctctagttaatgcttttaaagtatcataagcatcaggtacaccatattttcttaacattgtttgaattggctcagccaatacttcccatttttcatttaaatcactagcaagtttttctttgtttacaacacatttagctaacccattcattgtttcattgattgcctgtaatgaataaccaaatgctaaacctaaatttctttggcttgatgaatcagatagatctctttgcattcttgatttaggtaatttatttgataaagcaacacaaatattatttgacatatcaacgtttgcttcactgttttcaaaacgaattggattaactttatgaggcatcgtactacttccaacttctcctttaaccggaatttgtttaaagtattccattgaaatatatagccacatatcaacatcaaaatccactaaaacattattaaaatgacgaataccatctaaaatatggcaagtataatcatgactttcgatttgtgttgtcaaaggattaaaagttaagcccaaatactcttcaacgaatttttttgcaagactttgccagtcttcattaggaaaagctgttaagatagcactatagtttcccgtagccccattgaatttagctttaattttaaccgcttcaatattctcgatacttgataagaaacgataagcataaactttaaactctttaccaatcgttgttggcgtagcaggctgtccatgagtatgagctaacatcgcatcatctttatggtcagttgcccatttatcaataatagctgcaaattctttagcttttggtaaccagacatcttttaaaccatattttaacatgcaggcataagatgtattattgatatcttctgaagtacagccgatatgaacaaaactttgtaaataaccaaatcctaaagcatctactctttcatcaatgaaatattctactgctttaacatcatgacgcgttgtattttcaatttccttaattctcgcaaaagaatcatagttaaattcactagcaatagcagtaagtttatccatatcttttacatcaaatttagctaaaatatcactttcaacattttcaattaaaaatttcaaccattgaatttcaacgaaaactctatatttaactaatgcatattccgaaaaatattctcctaatgcatctttaacaccagaataacgtccatctaatggacaaagtgtcaaacattcaaattcttgtttttccattctattttccacccttaaaataatctacaccagcttcaaataatttttggtccatttcaccataaacatttttaaagcgattttcaccttgacgttcactatgtcccatcttaccgatgacacgaccatcacgtgaaataataccttcaattgcatacatcgatccatttggattatatggtgtctgcattgttaccttacgatttggatcaacatattgtgagaatacttgcccattttcaaataattcttcaataacttcttttggtgccacaaagcgaccttcaccatgactaacaggaattgtatggatatcatcaacatttacatattttaaccaaggtgatttgacactaccaattcgtgtatctaccatttgtgaaacatggcgtccaatagtattgaaagttaaagtcggatcatttttagacatctcctgaatcttaccatatggtaataatcctaatttaactaaagcctggaaaccgttacagataccgatcattaaaccgtcacgattttctaataaatcagtaattgcagcttttaagcgcggattctttaataccgttgcgataaatttaccagaaccttctggttcatccccagcactaaatccacctggtaacatcacgatattagcttgtttgatcgctgcttctaattcatcgatcgaatctttaagcatttgttctgttttatttctaattaatactaactcaactttagctccagctttttcaaaagcccgttttgaatcatattcacagtttgttcctgggaatactggaatcactactaaaggagtttcgacaactacctttgcttttaaatctgatcttgtctgacaagctgctactttaatttcactagttggtgccttttctcttgttggatagacattttctaatggtgctttattgattgcataagcttcatctaaagaaatcttatcactgccgtaagataaaacatcactttcattagttgtagccacaatacgataattatcaaatgtacttaaatctttttctgatttaacttcaataataatatttccataatcacgagcaacataactttctagactattttcggtattgaaagcaactccaacaccattaccaaaagccattttacttacagcttcaataactccaccgtcttttacagtatatgcactgtaaattttcttttctttcattaaggccatgattgcatcatactgcttttgtaaatgatcaaaatcaaatactctatatttatctttattaatgataatttcagccaaaacatgtcctgtttctttaatttctggtgtcataatgtcatcaacttcaccacttgtaattgcaaatgatacaagtgttggcggtacatggagttcttcaaaagaaccagacatactatctttaccaccaattgaaggtaattttaaagcactttgaactcgataagctcccagtaatgctgccattggtttaccccaactagttggattatctaataatttttcaaaatattcctggaatgaaaatctaattgtatgatagtttccacccattgctactattttagcgacagattcaacgattgcatacattgccccatgatatggtgaccattttgaaattagcggattataaccataagccatgattgaagctgttgttgtttcttttcctaatactggaatcaaagccgccatcccttcagtttcactatgatacttaattcctccaaatggtgataaaactgttccattaccaattgaagagtcaaatctttcaatcaatcctttttgtgaagccacacttaatttagataatgtatcttttactgttgaaacaaaatttgtttgtttttcttcatcaaatggtgtgttatcaaaatccggtaaagtgatttttacatcttgataacgtttagctccagctgcatctaagaaatcacgtgaaatattaacaatatctgctcccatatgtttcatcactaatctattttcatcagttactacagctacctggacaacttctaagttttctttagcacattcagctttgataaaatcagcatctttagcatcaataacgatagccatccgttcttgtgattcagaaatagcaagttcactacccgtcaaaccatcatatttctttaatacagcatctaaatcaataactaatcctggtgctaattcacctactgcaacacagactccaccagcaccaaaatcattacaacgaacaattttttcacttacttctttatttctaaataaacgctgaatctttctttcttcaactggattacctttttgaacttcagctcctgctgtttcaatcgatttaatatcatgagatttagaagaacctgttgcaccaccaattccatcacgaccggtacgtcctccaatcaataaaacaatatgatcttttaatggttccaaacgtttaacttgttctttcggagccgcagctactactgcaccaagttccattcttttagcgacataaccttcatcatagatttcatggacataacctgttgttaaaccgatttgatttccatatgaagagaatccatgagcagattcttgacatagtttacgttgtggtaatttccctttcatagtctcttccaatgatttacgaggatcaccagctcctgtaatacgcattgactgatatacataagcacgacctgaaagcggatctctaattgccccgcctagacatgttgctgctcccccaaaaggttcaatttctgttggatggttatgagtttcatttttaaacatcaataaccattgttcatcaccatcagttgtatgtacagttatttcgactgagcaggcattgatttcttcggatacttctaagtcatctaaataccctgttttacgtaattctttcattgagatcgttgcaagatccatcaaagttaaaggacgttttgtatcgattccataaactaaatgacgacttgttttataatcttcaatatctttttctaaaatttctttaaatgcaccattttcaatatctaaatcagtgataactgttgcaaatgttgtatgacgacagtgatcagaccaatatgtatctaatacttttaattctgtttccgttggatctcttttttcttcatttttaaaataatcctgggttacttttaaatcttcatagttcatcgccatcccgttgtcagctaaaaacttctcaagaccagctttatctaattcattaaatcccgtaatcgttggtactggtttaatatctggtgctttatcattaagatcttctggtttatccaaactagctaaacgctgatcgaccggattgattaaaaagctttggatctgttttaaaacagtatccttatcccctgtaaaagtaattgcaaagactcttgcacattttactttagcagttgtatttccagttaaaattgcaaaacattgttcacatgaatcagctctttgatcatattgaccaggtaaaaattcaatagcaaaaatagcttcatcatcatttttagggaaatcttcctgataaacatcatcaaccattggttctgataagatagtattaataccttgagctaaaatatcatcactaataccttgaacatcataacgattaatgatccttaatgtcttgatatctaatcctaattgttcaattaaattatgtttaatttcatttgcttcagttgcatacgctgctcttttttcaacatatatccgttttacctcactcataatatccccctatctaagtccaatgtcattacggtaatatttaccatcaaaatcgatttttttagctacagcataaactttacttcgaacattttctaatgaagaaccagttgcacaaatatttaaaactcgaccaccactagtcactaatttaccatctttgatagctgttccagcatggaaaattacacaatcatcacaatcatcaatatttttaatttcaattccttttggataacttcctggataaccaccacttgcaagcactaagcaggcaacatgttgatcattccatttaacttcaacatcttttaacgtcttagtcgcacaggcaaccataatatcatatagatcgctatctaagcgtaacatgatcgattgcgtttcgggatcaccaaaacgaacattaaattctaagacttttgcttttccatcttcaatcatcaagccaataaaaacaacaccacgataatccatctgatcagcctttaaacctgccataaagggctctaaaatatcttttttcaatacttcatccatattttcaggcataaatggatttggtgaaacagttcccatcccaccagtattgggaccagtattaccatcataaatttgtttatgatctttagcacttaccattggaacgatcgtttctccatcagtaaagcataataatgaacattcaaatcctgttaaaaattcttctaacacaactttgctgccagcaccatctaagctgccatcgatcatcatttcttttaatgtagttttagcatcatcaagattatcaacaatgacaacacctttaccagcagcaagtccatcggctttaataactaaaggataatcaaactccttaatagcttcaactgcttcttcataactatttacttctttgtatttagcagttggaatattatgtctaaccataaaatctttagaaaatgctttacttccttccaaagttgctgcctgtttagttggcccaaaagccataaatccagccgcttctaagtcatcagccaagccgttacataaaggaacttcaggcccaatgacagttaaatctattttgttttcacgaacaaaattaacgatcatttcattatcttcaacactaccactaatacattcaccgatcttagcaattcccggattacctggaattgctaagatctgatcaactttattactttggtttaatttataagcaatggcatgttcacgtccaccactaccaattacaagtactttcataagttctaaacctttctattaatgtctaaaatgccggtatcctgtaaataccattgggatccctttttcattacaaaaatcaattgaatcctgatcacgaatcgaaccaccaggttgaacgattgccccaattccggcattataagcaacctgggcacaatcactaaatgggaagaacgcatcactagcaagtactgccccattaaaatctttatcaggattattatggattgcattttctaatgcccaaactcttgaagtttgaccaccaccaacagctagtgtaacgccatttttaacgatacagatagcattagatttaacaaatttaacgacccgcattccaaattccatatcactgagctgttcttccgttggtttagcttcagttacacaattcatctctttgatcatttcagtattaatatcttgaactaataccttaccttctaaatatttaatatcatatttagcttctcgtacatcaatatttttaagttttaaaattcgtaaatttttcttttttttcaatacttctaaagcatcatcatcaaaatctggtgctgctacgatttctaagaagatcttgtgcatttcttcagctgtctttttatcaattttatagttaacagcaacaattcccccaaaaatactttgtggatcagcttcataagctttcatatacgaatcataaccatctttaccgatcgctacaccgcaaggagttgagtgtttaatggccgctgttacgatttgatctttaaattcacgaactaccgctacagccccatatagatcattaacgttattaaatgaaatttctttaccgtgtaattgttcataatctaataagctgtgctgtacaaatggatcaacataactatttgctctttgctgtgaattttcaccataacgtaaatgttctgttttctttaaactaatatttaatgtatctgggaaatcatcaccaacaacacctgcaaaataacgagaaatcatggcatcataggcccctgtcgttgaaaatgctttatatgcaagatttaatctaaaatcaaaatcgtcattattttctttaattgccgataaaacattatcataatctttaggatcagtaacaattaaaacatctttaaaattctttgctgctgaacgaatcattgaaggaccaccaatatcaatattttcaatcatctcagccattggtttacctgcttttaaagctttttcaaattcatataaattaacacacactaaatcaattggttgaatatccatttctttaactgtgtttacatgttcttctagatcacgacggaataataaaccgccatgaactttaggatgtaatgttttaacccgaccatctaaaatttctggaaatcccgttacatcatcaattgcaatacatgggacatttgcttcctgtaattttgccattgttccccctgtagaaacaatttcaaatcctaactcaactaaccctttacaaaaatcaacaataccatctttattcgtaacactaactaatgctcttttcatttatttcaccttagccctttcattttcgataacgatcttaccatcacaatacaaagctactgctttaggcaagatacgatgttcgatttctaaaactctagcctgaatatcctcaggatcatctaaatcatcaatattacaagcttcttgaagtatgattggtcctccatcaacttctttattgacaaaatgaactgttgcccctgttactttaacaccccgtgctaatactttttcatgaacgtgcataccataatatcctggcccacaaaaagaaggaataagtgatggatgaatattgatgatcttatttggataagcatcaatcagtacatcagtaagaattgccagataacctgccaaaacaactaaatcgacctcacgttctttaagcatcttaacaatcaattcatcatcttttctaacgactgctgtttcaattccggcttttttagcccgttctagaccaaaagcatttttacggttagaaataaccaaaacgatttttccattaatacttttattttcaactgcatcaataactgattgtaagtctgttcccccaccagaaataaagacagcaatctttaacataacttgactcctttatcaccagcttcgatattaccaactacataacatttatcaccagcagcttcaattgcttccatcgctttttcaacatcacctggatctaaggcaatgaccatcccaagtcccatattgaatgtgttatacatcatctcttgagcaatatcaccatttttagcaattaaatcgaagattgctggaacttcatagctgtctttgttaataattgctttaactccttcaggtaacattcgtggaacattttcaaagaatccaccaccagtaatatgagagcagccttttactttaatacctgcatctttaatatttttaagtgccttgacataaattctagttggttcaatcaaagcttcaccaagtgtcttacctaattcatcataatatgtatctaatgattctttgctcatttcaaaaacctgacgtactagagaaaaaccattactatgaacaccacttgaggcaatccctactaaaacatctccaggtttgatatcttcaccattgataatatcttttttatcaacgaccccaactgcaaatcctgctaaatcataatcatcttcaggcattaatccaggatgctcagctgtttcaccaccaactaatgcacaaccagattgtttacaaccttcagctacaccacttacgatcgttgcaattttttcaggataattttttccacaagcaatataatctaaaaagaataagggttcaccaccagaacaagcaatatcatttacgcacatcgcaactgcatcgattccgatcgtatcatgtttatccatgataaatgctaattttacttttgtcccacatccatcagttcctgacaaaagaacaggttcatccatctctttgattgcacttaaatcaaaggctccagcaaatccgccaagcccgccaagaacttctggtcgcattgtttctttaacatgttttttcattaattcaacagatttatatcctgcttcaatatctactccggcctttttataatccatctttggtctccttctattatttttgcattcttgctaaaactgctttataagtttcaatcaaatcaccgatatcttgtctaaatacatctttatcatatttttgattagtttcaacatcccataaacgacaagaatctggagaaatttcatcagctaataagatttcaccatcagctgttttaccaaattcaattttaaaatcaactaattttaaatttaagcttaagaagaactcttttaataactcattgatttttaaagtttcttgtttaataaaattatattcatctcttgtacataattttaaagctattgcatgatcttcattgatcaaaggatctccataatcatcatttttatagcttaattcaaagatcggttcatctaaaacaattccttctggagctcctaatcttttacaaaaagatcctgttgtaatatttctaataattacttccaatgggaaaatatccacttttttaactaaaatatcacgatcatttaatttcttgatcatatgtgttttgattcccgcttcttcaagcatatcaaagataatacaagaaattgtattatttaaaacacccttaccttcaaactgatcatgtttaacaccattaccagctgttgcatcatctttatagtgaattaaatattcatcatctttatcagtcttataaacttgttttgcttttccttcatataataattctgccatttttctaatttctccttttacctttatttatattttgccataacttccacatttgcttccatcgcttgaacttccatttctttacgataagcaactaatttttctttaatgctttcatgtttgatagccatgatctgtaaagctaaataagccgcatttttacttccattgattgctacagttgctactggaattcctgaaggcatttgtacgattgataataaagcatccattccatctaaagttgctccactaattggcaccccaattactggtaaaactgtttgtgaagcaacaacaccaggtaaagccgcagccattccggcagcagtaatgattacttctgttccatctgtttctgtttctttaataaatgagcttaatcctaaatgtgcgcgatgtgctgaaagacatctaacatttacttcaacaccataatctttcaaaattccaattgctggttcaaccttgtttaaatcactagtagaacccataataattgctactttcataatttcaccctttctttttaaaccactaaaagtgacctgcgtcacttttaaaataaaccgacaatcttaccatctttatcaatatccatattaactgcagctggacgttttggcagtcctggcattctcataatacttcctgagatagccactaaaaatcctgcccctgcagaaggaataagatcattgatcttaaccgtaaaaccactaggtcgtcctaataatgtcgcctggtctgataaagaatattgagttttcgctacacaaattggcagttttcctaacccttgagcttcatacttcttcatctttgttaaaacttttttatcaaaggcaacaccatcagcaccatagatttctttagcgatgatttcgattttttctttaattgatatatctaaactatataaaggctgataattagcttctttagtatctaaaatttctaataatttttcagctaattcaatacccccatcagcacctttttcccatactttagagatcgctacatcaacccctaatttattacatgtatcttttaataattgtaattcagcttctgtatccgtcggaaatgcattaatagcaactacagaaggaatactatatttagcaatattttcaatatgtttttctaagttttgaacacctttagctaaagcttcaagattttctgttgataattcttttttatcaacgccaccatgcatctttaaagctctaacagtcgctacgataactaccgcttgaggatcaagaccagcttgccggcatttgatatctaagaacttttcagcccctagatcagctccaaaccctgcttcagtgattgcataatcacctaatttgattgcaagtttagtagccataactgaattacagccatgggcaatattagcaaacggtcctccgtgaacaaaaacgggcgtatgatctaatgtttgaactaaatttggtttgattgcatcttttaataataaagtaaccgcaccagttgcttcaatatcgtcaactgtaactggatttccttcatagttataagcaacgatcattttgccagcacgctcttttaaatcttcaagactagtagccagacataaaatcgccattacttcactagcaacgctaatatcaaaaccatcttcacgtggcacaccgtttaattttccacctaaaccgcacactgtatgacgtaaagcgcggtcatttaagtcaactactcttttccaaacgatattacgaacatcaatatttaacggatttccttgatgaatcgaattatcaagcatcgctgcgatcaaattattagcagcagtaatagcatgaatatcgccagtaaaatgtaaattgatatcttccattggaactacctgagcatatccgcccccagcagctccccctttaattccaaaacatggtcctaaagatggttctctcattgctacaactgatttttttcccattttatttaaagcctgagaaagaccgatcatcgtagttgttttcccttctccagccggtgtgggattgattgctgtaacaagaactaatttcccatcaggattattttccaaacgattaattgcttcaagagcaatttttgctttatatttcccatataattctaaatcatcatcttctaaaccaacttttttagcaatctcactaattggttccatcttcgcactttgtgcaatttcaacatcagttaacataacgccaccctttcacatataatttttaaaatataaatctaaggtcagtctctatcaaaataaaaatacaactaatttatatcatatttccacttttttctcaactagtacaatagtttaaaaacaagcattttgaccatagaattaaaaaagagcctacacctatccagactcttgcccagacggtcggctcttcaatgattatactccctgtggttaattccacttccgtcagtcgtataactatttgcatgatatcatttattgattcaagattcaagcatttactactaaaacaatttaattttataaaattacttaaaattaataattcttcaaattttatatactatccaattttctataaattttgatacaaacaagcattcataaagactgcctctttatatatagatatgaaattacaaaactaaaatttatctactttttctttggaatcgccatgcctatcaacattcctaaaataagacctaatccagtgcacattcctccccaggcaatttgtccaaacatggcaagtatagccatacctgcacttcctgccataacaccgaagcacattcccaaagtcatataattttcttgtttctgcccattttcattttttacattctttaatttcgctttcttcatttacagtacctttacaaattctcatttatttaaccatttgactcttatattttctttgtaatttaacacttaaaattattgcaattataggtgatataactacacctatgatcaagaacaatatccataacccactattcttatagagcaaatacatagtaacttctaaaaaaattaagaaaatgataaagaatatattcaggtttttagtatcttctttccagtatgtttctttatctgaagcatttaaagatttataaaattcatttccattatcataatctcgaacaacttttattttagaatttcttattatattcattagaaaccatgttactaaatatactacattaataacactaattaaaatgatattttccatttaatatcagcctctccttaaattcaagttatctcttgctatacaaatgaggattctgtttggacttatcttttatcgattctccattttcgtcaatttctccctcaatccatgtcataataccaaagttacaaaaagggcatgtaattgcttctttgaaaacctcttgattgcagcgtgggcatacaacatattcttcatcctttatattactcatctgtttatttttcctttacaaattctcatttatctatttcttcctttttgttttgggattggtaattcctcatacatagcattaaacaaacctgttaaaaattccttattatcaacctcatctacaaacaacatttcttttgccccctcataaggcgattcatacgaaactgttgacatgtagttaattgctgattttattggttttacaagcagcctatcatcatagataccacctacgattttaccacgatagtaaataataaattctcccatcatcgctcgatatgtaatttcttctaactctgataactgctctaaaatgaattgtaaatattctttacttgacgccatgatttcacctcaaattcaatttatttttgtatcaaaattctaatatttcaaaatcacaactccttttatagttaatctttcatttctgctatattaatatgatctatcatttactcatctgtctaatatcttttaccggtatagatttataaattaaactgcgtttattttttatagcgatgatacaaatttgagactaattaaaagtatgaacatgataaaataagtgatctttactgttttcaactaaaaaaagaatcgctggtttatgaattcctactactgaagattaaaaataaaatattgtcaataactatatttttgaattttatctaaaactctttgtttttcactaccatctaaaatcattggctgataattatttctgcccttaactgaagttattgaacatggaataatttcatgactatcaccggaataattaccatctgtaaaattcatcgtaatagaatagatcatcgaatctgtatcgctaggattacgattcccaccaaaacaaaaatttcctaaagaataaacgatctgtttaccattatactcttcaacaccctgaacaacatgaggatgcgaacccatgactaaatcagcgccactatcaattgtaaatttagctaattcacgttgatcactattagcataatattcgcgttctattccccaatgataaaatactacgattgcattagccccctgattattttttaaatcatcgattgcattttttattgttgcacgtccttgttcattattcatggaaagagacattgaacgatatcccaaaaaaccaattttaattcccttaacctctttaacacacgctgtttcataaccaaaataaccaattttcttttcgtctaatacttgtttagtatctttcataccctgagtataataatcttctgaatgattatttgctagtgaaacaagttcaacactaccactagttaaaatatccgcatattcttttggtccactaaaaggaaactgcttttccacatgagatgttgcacttgtcaacggaccttcaagattaacgatcgttaaatcatcattttcaaaaacacttttaacattttttaaaaaatatgtcgcatcactaccttgctttgcatattcttgattaaatgaaccatcgtaaatctgtcccgcataatttcctagtgtacagtccccagcaaaacttagtttcacacttgttttaaccggttcatgtttctcttctgtttgtactttttcatcattttctgtactctcattgctttcttcttcagtaataaaagagcatccaacaataaaaaatagcattattaaacaaagtaaaatctttttcatatcctttccacctctttattaaaagtatatcatacaatgaaaccttttacattaaataaaactttgatataatacatatcaggaagtgaaagaaatgataaaagaaataaaaaataaaatggattttgatgaattattaactgaaagcgaccctaatatcaacctagttagagattatttagaaaacggtaaattatatggctattttgtaaacgatgagcctgtatcatttattgctgttgaaattatcgatggtgaagtagaaattaaaaatattttaactttagttgcatatcgaggttgtggttatgctaaagctttaattaaatatgttgaagatatctacagtacttatgatacatttttgattggtactgcaaactcaagtttagaaaatataactttttatactcgtttaggttatgtgtatagtcatcgtatcgaaaatttctttttagactattaccctaaagaaatcatcgaaaatgaaatgcaggcaactgatctaatgtattttaaaaaaagcagaaaaggtttgaattaacacaacatgtaaaaagacagtcgatcaaattgactgtctttttattgatatctcgactttagataaatatcattgataaaatattaactagaattcttttttattcataatacctacgctaattttaaatgataacaaaaatatgatcattgctattattgatcctgccatgatcaacattttcatactcattactggtaaattattaaacattgtaattaaatcaacattgaataattcagcagctttaattacaccaataacaatgataaatatcaaaccaatagccccaataattgcaacccgacttttttcaccaccaaacttaaattgaaaagggagcataactgccaatattatcagtagtattggtaagattattaaggcaatcaatattgtatcctcgattaaaattgtatcttttattatttccacaacaacagtaacaatgatagcaaacaaccatgagattcctccaacaatcaaaccaaatccatatttttctaaaatataatcttttctagtaattggcaacgaaaataaaaaagcattaccattatcaaattcatcataactaatagtacttaaagtaaataaagaaccaacaaatgtcatatatccgataataaatgatgcatcttccataaaaatagccattataccagcaatcgcgataatagtaataaaaaaatttttttgtccttgtaatagtttaaaatctttgatcaataaacctttcatagtttatcaccccttatcatcattgtgattacttcatcaatattccctttttcgattgctagagaaggataattatcaagataatattgtctctggtttgtaagacagctatacccatagctttctttcttcaaacaaagaagatattgtttatctagactagcatactgctttaaatcaactttcaataaagcataatcactcaataaaatatcagtatcttcatgcataatgatttttccattatcaatcatataaaggtcatcacataaattttctaaatcactagaaatatgcgaactaattaaaatagaatgagcctcatctttttccataaattctcttaatatatccaataattcatctcttgcaataacatctaaaccagctgttggttcatcaagaatcaataatttagcattgtgagaaattgcaactaaaacttttaattttgctttcatccccgttgaaaattctttgattttcttattacgaggtaattgaaatcgttgtaactgttcaataaaaaatgatttatcaaaatttttataaagattatctaaaacaggaataatatcattaatcgttaaatatccactaaatcctgaatcagataaaaccacacctagattctgcttatcttcagcattaaaattttgaatatcttttccaaaaacactaatgcttccttcatcaatagaaatcaatcccaatattgctttaaatgtcgtacttttaccagcaccattttgtccaattaatcccgttacacatcctggcatgacctttaaggaacaatctaatgagaaattcttatagaatttttttacatgttcaatttttaacataatttcctccatttctgtttgccttcatcgatagggtacaaacatgtgattaaaatttcaatctactattaatctaaaaagtttattttcacgtttatccttccaaaatcaattcaaataaagttttaatatcttcatcacttataccacatcgtcttcctttttgaattgctttttctaaatcagcttcaacctcttttttttgttcttccagcaaaagctcagtattagtagcagccacatatgtccctttaccatgaacagttattgtaaaaccttcattttctaaagtatcatatgctttttttaccgttaaagcactaattttaagttcttttgataaagtacgcacagatggtagattatcattttcttttagttctccattacgaatcaagagtttgatttgatctactatttgttcataaataggaaccataattgtattatttataattattttcaatttatctacctcctttataaaacagtatataacagtacaaaactgtagtcaagtgttatatactgtttgtcacaaaaatatattacaaataaaaaaacagttgatcattatttagataactgttttaataattaagatattatttttttacattagaatgtaaccattttgaaaacaactctaaacctgcctggatatcttcgcttttattagcaaaaccaaagcgtagatgatattcttgattaaaacaagcgccaggaacaaagaagacaccggtatctttttgtaatttgagacatagttcttttgatttgattggcaggttatattttagaaaagcaatcgttcccgcttcaggaacaacacaatcaactaaaggttccttttttaaccactcgattaaaatctgacggttagtagcaatgattttcttacttctttcaataattctatcataattttcaattactacagcagctaaataatcatttagataaccagttgaaataatatgataatcacgtcgatcatttatcattttaataatttcataattagctttgatccaccctaatctaagccccgcaaaagaagttacttttgataaactgctcgttgaaattcctcgatcgtataaatcactgatagctatttcatctttacctaaaccctgataaacttcatcgcaaagaatatataaattatattttttagctaacttgaccaatttcaataaaaattctttagaaaattttgtacttgtaggattattaggattaactaaacaaatcatcttcgtattttctttgatttctttttcaaaatcttctaatttaggtaaccagttgttttcctcttttaattcaattaagcttgtctctaccccaaacgattctggaaaagaatacatttgttgataagtcggtgtaatcgttattaaatgatcatttttttctaacagcgaaattaaaactaattcatttgcattgatgcaaccatgactaattgcaatattattcaaatcaccagtttgatacaattttgcgattcctctacgtaaacgctcactgcctgtaataggtccataatccagcttcgtcgttaataaatcattgagcagcttgtctttatcatctacaaattctaataaatcattgatgctcattgaggcaacacatgtctccgccaaattataacgataatcgacttcatgctctgtcatccaggcttcaacatcaaaaaaatcaattttcactaatgcatcaccttgcttaaaaaatctttagcacgttcagatttaggattcgtaaagaaatcttttgaaggactatcttctattatttttccattctctaaaaaaatcaccctatcaccaactgttcgtgcaaatcccatttcatgagtaactacgaccatcgtcattccctcaatcgctaattcctgcattacttccaaaacttcaataaccatctctggatccaaggcactagtaggctcatcaaataacatgacttcagggtccatacataaagctcttgcaatcgctactctttgtttttgaccccctgataatttattaggatattcatcttttttatccaacaacccaacacgttctaataacttacaagctttttgttttgctgcttcttcatctgcttgtaataccttaattggcgccagtgtcaaattttccaaaacagttttatgcggaaacaagttaaaatgctgaaaaacaaatcccatctttcctcttaaagctttgaattgttgggaatcagtactatcaagtaattgattatttatataaatttctccagattctggaatttctaatccgtttatacagcgtaagacagtactttttccacttccacttggaccaatcaaacaaacgatctcacctttttttatttctaaggaaacatcatttacagctttcaaatctttaaattgtttaacaatatttttaactttaatcactttcagataacttcctttctatctttcttgcaaaataagatgtagtcagcgtcataatcaaataaaaaactgctgacattagtaatggtggaattaaattaaaggtgttagctcctaaaatttgcgctgaatataataattctgtagctcctaaaaccgaaatcaatgatgaatctttgattaatgtaataaactcactaactattggtggaacgattcttttaaaagcctgaggcaaaataaccagcttcatcgtttgactataattcaatcctaaaacttcacatgcttcccactgacctttatcaactcccatgattccactacgaatcaactcagttgaataagctccactattaatactcatagctacagcaccacaaacataaggatcgggtataaacctttctcctgtaattgctcttaccattaatggaaaagcaatatataaaaataatatttgtagtaacatcggtgtcccacgaatcaattcaacataaatatttccaataattcttaaaatcttatgtttagaaatttttgctgcagctcccaaaacacccaaaatcaatccaaacactaaagcacaagcagctagtaaaagcgacttaccagctccttgcaataaaaagatcaaattatcagcagtaaaaaattcaattaacgcattcacgattatgctccccacttagtttttaattcttgatatttatctgatccaacaaaagcctttaaagcttcattaatatcatccattaattcttgattatttttattagtaataattagattttcctcttccaataaagtttcatctaacattctataaccagcttctttaacatagtttttagctacagcctcatccaaaacaactgcatcgatcccaccagaatttaatgtttcaatcaaaactttaacatctttaacagacttaacattagcatctttaatatcattagcaaccccttcaccagtagatgctaactgagctccgatatttttaccctctaaatctttagctgtagtaattggactatcattagcaactaaagcaacttgtctagaatcattatatttgtttgaccaaataacatctttccattcttcatgaaaagtaaaaccagaaatacccaaatcaatttgatcagctactaaactagtcgaaatagtgtcaaatgaaagttttttgaattcatattcataatcatgtccattttctttcatgatattaaataactcttcggtcatatcaatatcaaaccctaccattttatcaccatctaatgattcatatggtggataatcaggtgatatcccaattaaaattttcttactcgaactaccagcatttccaccacaagcagccagtgaaacggccattacacaaactaacaatacttttaataattttttcatttttcttctttcctttctccagcaaaaataaaaatctcttagctaagctaagagacgaaatttccgcggtaccactcttattgatataaagattatatcccctcttgtctgtaaagtagacttactgactatcctactaataattcaaatagtcctcttcaaagtgcggttcatttaatcttgtttactgatcttacaccaccatcagctcgcttaaaaacgcaattaaactactctctttatcaatgagtttataatatatagttgtattatataaaaaatcaatttattgtcaactgttttagttattttatcttaagaaatttatgattaaagtgatcaatttgtttacaagttttctctaatatttcattatatccttctaattcatttaaagtctcatcaagcatctcatttgtttgattgatcatctcgatattttgatgatatttttttgtatttaaacgttttctttcatcactacgaagtaacatcaaacaaccaatgatcaataatccaaaaattcctacgatcattaaaaaccattttattatttccatctaatcacctactttagtataccacattttttcattcaatccacccaaaatatttacatgcatattcaatccccgcttcttgactcgatttagtaataaaagtggctgcttttttcacctcatctacagcattccccattgcaatagaaattggagcctgttttatcatcgaaagatcattgattccatcaccaaatacaacaatatcttctttattacctcctaatatatcaatcatttttaagattccacgatatttatccatcggttcaataatcaaatagctgtcctgataacgaacatgacctattttattaagagaacataattgtttttcttcctcttttaaaatcataataaaaattttataaatatttttaatctgatgaaaatcaagattttcatcaacaataattttattatgcatttgataattattgatcaagttgttacaactatataattcataagtatcattcagtgccaatccaaaagcaaaattctttttaatacactcatcgataatttccaaacacatagtatgatctaaaggctcattttccaataatcgatcatctacaacaagtccatttccaccattacatactaaattatcgattttgaccagacgactaaattttcttgcattccaatgagcacgaccagttgctatcgcaacaaaatgaccatttgcttttaatttttctaatgttttaaatgttgaatctaaaatgactccattactattttgattagttaaagtcccgtcgatatcaaaaaagaaatatttcatcaagatcacctcttctaacattataacttatctaaacaaaataacaatatttgattaaaggaataaaaaaagctcatactaaattagaaggagtgataaaattatgccatatattactgacatatatgcaagacaagtattggattcaagaggttttcctactattcaagttgaaataacaacagaaagcggttttcaaggtagtgctatcgttcctagcggtgcatcaactggaaaatatgaagcattagaattacgtgacaatgacgaaatgcgctatttaggtaaaagtgtctttaaagctgtcaacaatgtaaatgaaacaatcaaccggctgttaaaacaaaaaagtgttttaaatcaacgcgaaatcgacttagcaatgattcgctatgataatactgaaaacaaatccaaattaggagctaatgccatgttagcagtatctttagctgcagctaactgtgctgctaattatctcgatatccccttatatcgttatttaggcggctgtaatgcaaaaatattaccaacgccaatgatcaacattattaatggaggttcccatgcaacaaactcattagactttcaagaatttatgatcatgccgattagtgctaattctttctatcaggcaatggaaatggcaacaaatgttttccatactttaaaaaacattcttaaaaaaagcaatctagcgacttcagtcggtgatgaaggtgggtttgctccaaatttagaaagcaatgatgatgctttagatttgattattaaagcaattaaagaatgtcatttagaacctggtaaagatatcgctattgctttagatgtagcctctagcgaactgtatcatgatggtatctatacaattaatggtcatgattatacaagtgaagaactaatcaaatattatgaacaattgataaataaatatcctattatttcaatcgaagatggtttggatcaagaggattatgagggctggaaaaaacttactaacaggctaaatgataaaattcaattagtaggtgatgacttatttgttacaaataccaaaagattacaggcaggcattgatggacactatagtaacagtattttaattaaactaaatcaaattggtactttaacagaaacaatagactgtattgaattagctcgtaaaaataatattgcccctattatctctcatcgttctggagaaagtgaggatacttttattgctgatttagcagttgctttaaatattggtcaaatcaaaacaggctcaatgtccagaagtgaacgtatttgtaaatataaccggcttttaaaaatcgaagatgatttagctggcagttcttattatcaaggcaaaataaataataaataaaacgacttattgcaattaagtcgttttttatattaatgaataaaacaatttgatttttgttataaaatttgtcatacttataaaagcagccaacaaaacaatttatttctctatatattaaatcactatttagtagtgatattattaaaggaggaaaaaaatgtattcaattgcaatttgcaatagtgatagattagatttgtcactactgtcgcaatatgtggaactatggcttaatcagcataaagaagttgattggaaaataactacatttttacaagttgatgaactagtcgagatgattgataaaaagaaatatttcgatctttatttactcgatatcaccttacccgatattaatggtattgaacttggacgaataattcgcaaaaataacaatgatagtcctatcatttatataacatcatatcctgattttgcattagaagcttatgaaatccacgctcttagatatattactaaaccaataaataccgatgaattatattcagcattagattttgcatacatgttattttgtaatcaacccgtaaatacaattttaattaaagaaaatgattcacttactagtgtagtaatcgatgatatcatgtatatcgaaaataaaattcgcagcactacctacacattaaataataataaacaaatcataagtattcggcgtactggctcttttgaacaagcactgggaccgctattacagataccatattttattcaaacacataagtctttttttataaatttaaaatatgtcaatgctttgcactctaatgctgttacaatggatgatgataaaaagattcccattagtcgaaaacatgtctcgtccgttcgaacaaattatttgaattttatatctcaaaaaggtcatttagtgtaatttaataatattagccaaaaatttaattttattttcttataatacattaacatattaagatataaatgacaaattcttacattagtttcatttgactatcaaatactaactaacataaaaacaaaagatcttcaaaccatttctatacatctataataataaaaaagatataacttaacaaatgtaaattgtctatatttgttaagttatataatatccactatctattttataaattaaaaatcataacttctctatttgctttaaccttaaaaattgctgaatacacattttactcttcaaataaataaaattaaaaattcattacttaacacttaaagtatcaagacatcttctttataacacataaaaaaacaatcttttcaaataataattttaaagctcaaaccttcactaaatacagtgattttttttgtgcaaaattgcccctaatcaagcaaaactgacacataagctaaatttattatatgataaaatactaaatgtatgtaaatatacatactaatcacgttatcaaaagtggagaatgtttataaagagaaatataggttggctgcaaaaactatattttgctattaattaaaaactgcatatttaataccaagatgttttattaatcaaaatattaaaaagcaatattattacatttctccactcacgtgattaaatattaactaatgttaattatgggccatttaacattgttaatcaatgatattgcttataatgataaaaactttaatttatatgataaaattcatgtagttcatagttatgcagtcttatttatataaaaatatcgctatctagcgatatttttatttgtcttttttttacaataaatgaaagtaataattacaataattcctagtattcctatcatgacatatggcaggttttgttcaattgctattccttttttagaagaaataatcttagtatctttattatcagtaatatttccatcaaattcatcactacgaacacagtaaaccacatatctttgataattatgacgataaggatgacatgttatcaatgtaatcatatctttatcatcttgaattaatatttgtttactttcactaggataaattacttttattttggaaacattatactctaattgttcccaaaaattttgaataattattttatcacctatttctaaatcttcaatatctctaaaaaaaggtgctccttgataaccacgatgtccagccaaaacacaattactattttttccaccaataggtaaagaagtgttccccaaattaacaattccttttgccatattttccttagttgcccctaaataaatcggtaattcaagattcattttaggaatcgtgatcgtcgcaattacatcatttttataatcataattatttaatgtaaactcctcttgttcaaaagtccaggcatcacttatatcagattgtcctgttaaatataaattttgattatattgatacatttcttgatataatggatccgattctttaggttgagaagatatttcagtagctttaaattcattaattgtcgtcttgatgtcattacttatcaaccaggaagaaatttgtggatacaagaaaattcccaatcctacaaaaaagccaacaattgtaagtataattagaaatttccttaacattaacgtttcctccttacctttctagttattctctttgccacaaaaacaataaccaaaatgacaacgatcacacctacaccgctaataatcgatttaatatattctttaaaccaaatatcatcattacttttattagcctcttttttctcatcatcaggattatattcgactcgatgacctcgaactaataaacgatgactatttattccaaaaggtgtacatgttactagtgtaacatagtcctcacccttagtaattcttaagtcatcagtctctgtaggttttactactttaatattatcgacttcatacgctaaaacttcatccaacacataaatataaaatagatcacctttttctagatcaactaaattagtaaataaatcagctgaagaaaggccagaatgagctgataaaactgcatgactgtcgactccaccaattggtagagaagttcctactaaatgtcctacccctttaagcatatgttcttgatcagtaccatgataaattggcaaattaacgccaatacgaggaattttaatatatcccataactccatcatttgtaaagttcaagatttcataatactgctcgtctgccatactaatagcattaggatcaaacggatcggataaaatcactgtctgattaagtttacgattataagtaagggctaattctttttcttgagcaatcttttcttcatcgctatcagcgacctctttttgatattcattgatgacatccatttgactccttttagcatacatattactaactaagggatataaactaattgctaggccagctataaatccaattattaatattattttaactactcttttcttcacagtaacatcctttatgtaaataaagaactaccaaagtagttctttatttaattaattttctttttttcttaacttaacaaatactgttatcatacttgccataatcaaaataccaccaacagtaaacatccaagtaccagcaccaccagtttttggtaaattgaatcctttagtattagcgaatcttgttacgacaactttactaattgaaccaccattttcaatagcagtagtttctgcaattacagtaccatttaatctatattcaacatcacctgtttctaaatcagcatcgatttccaatttagctttaccatctaaaatttgatatccttcaggtgcttttgtttcttctagataataagttccagcttctaatccaacgaaatatgcaagaccattttcatcagtttcaactaaaccatcaccactaacaactccattttcatcatattcataagccgcaattacatttccagcttcatcttgtaattcgaaagctgcaccagctaattttgtattttcattttcagcatcatattttaaaatctgaagaccataagtgtaagtttttgtttcatcccaaggtttagaagtttgcccagtagttggattgttagtatattctaatgtaacttcattagggttttcgccaccaccaataactgcattttcattaattacagcataataatttaattgtaaagtattataagccatgatgtttggataaacaaaatctattgtcatcgtcttaccatctgcactgtatgatacagtatagtcataatcattgttttcaccattatttgctactaatgttctttcattaccagcaaaatcagccacaacgattttaagatcatcttgacgagtaaaatctaatcccgcacttaatgtatcggtaattgtatatttaattgaacttaaaagtgtagaagcatcataatgtggaattgctgtatctacttgatattcaagaacatcaccaatattgtttgtacttgtattaactaattcgaattcttccccattttgtttacgaatatttttatctaatgttacaggttcatctttaggttctattactaaatcaaaattccatttagcatcaccattatcatctttatcaacgtatggtaaaggaactaacattgattttgaagctacactagcagatgaagctgtagttccagtttcaacaataatatataatcctaattctaaaccactagctgtagcagaagctccttcagcatctgcacatgcaatcgttgcagctggatttatatcattagtattaataaatgcttgtacatcagttgtaaaattagatgttgcttcagtaattggatcttcaatacttgataaattaccatcattatcaaatattttaatatttaactgattaggcattttagcaatatcatcaatactatattttccattttcaccaattaaaccagtaaatgcattatttacagtataattatagacattagtttgtccatttttataattagcatctaaaattttataaatactaaatgttgatcctctttttgaaatcgtaattgatcctgaagttttactagaatcaattactgggttgttcttagtatcaaccttttcacttgctcctgcaggcatcattaaagcaaatgccattaggaaaacaataattgtactaaataatttcttcatattttcctctcctcattcatatttaattttttttattatttaatttttttatcaatatggccataaatcccataatcacaattcctaaagacgcaattcttgcagttaaagtagcaccagtattaggcaaattaacaccaactttatcagaaactgtgaatgttataatttttgtatcatcagaaaaagtgctctcaatgccattaatatctgtagtatcatattcaaatggtacactaaactcaataacttctgttatgagttcatatccagggggagcttcaatttctctgatcatgtattgaccttcgctaagtttttcaaaataagccaagccatcatcaccagtagttgcagtaccaacactatcccactgttcttgctcattaagcttaaataactcaaacgaagctccttttaatacttctccatttttactatctatttttttaacttttacattaaaagattcattaattatggtataaccttctgattgatcaccactaatcagattatcgttttcatcattatcagcactgatcttaaaagtatttttagaagcatcaactactactgtccaggtcgtttctggtactaaataaccatcaggtacaacaatttcagtcattttataagtgccagtattaacattttcgaatactacttttccatcttcaccactagtaacttctttgctccagctacatccttcatctgtcaaataatcaccacaatcagtatggggatcagtacattgactatacccgccattggcatctttacaatgttcagtatgcttatgtgtacactctaatctaaatactgctccagctaatggcgtttgaacaacttcgcctgtaccatctaaaccgctaccatttttcgtaaactcaacattagtaactggtcgtggatctgatgtaagcaattctttatgatatacaaagaaagctttgatattaacttcaccatcaataattccaggtgcatcattattacctttattagaattgatccaatcagcaacttcttgagcagtagtaaatgttactccatcctgaggccctgtaattgttttataagcctgtgtatctcgatcaaaataagtaatctcaagatgatctaacgcataattaggatcttcagatatattaacttcaacattattcgaatatcgatctatgtatacagtatccggatcttcttgaatagttccagcattgatatttaaatctttatcaccaccagaaacagttatctctcgctcatcagcgataacactaaagctaattttactttcattgatcaaatagccttcaggtgcctcaaactctaataaataatattcaccaaccggcaacgtatcatcaatccaaaattcaccattatcatcagtaatatattctttatcagaaactctttcattcgttgaagcatcatataaataatatttagcaccaacaacttttttaccactataatcacatgttgcagatttgctaactttaatgtcaactttgacatctttttcagctacaactggcatataaatacgagcatcaaaactagttccataatcaaaagtaactgaatcccatgatggcgtatcaattcctgcaataatttgatttttataaaaaggaatagcatcactcaaactaatacctgttcttataagagctcgtccactatgcttaatattatctatttctaaaatattattatttaattgatcatagttaatataagcatcttcatttatagtagtaataccaggagcatcgataaatcttgtagcttttccaccatctctgatttcatcagaaaatttaatttcgtgaccatctttttcaagttttggtaaatcaatctgtttaataattgaccactcagcttcaccaccttttttaatggcatttaatgaatctgtttcaatattcggtagttctccactaattcgtaaaataattcgtcctaccaaatgagcgtatttagtaattggatttcctgacaaattaattgttaaattatctctgtttttaaaccaggtttccatttcagctctatctgaaacattttccacatccattatataattaactgaaagtggtgttagatcactaattttgttttttatatcttgattatcagcattatatttattactaagatcaatacttattgcatttcttaaacattcgattcctacaatgctttcaatgcctcgattagatgcatcgatacttccatcaaattcagcaagtatttctctaacatttttagattcatcaccgaaatagccttcttcaactaaagcatcatatatagcagttgcaaaatttatatcttctacaccggcttccatgatttgatttatcccattatctctattcgtactatctattgggccctgaggaatagtgacactagctgatgataaaactgtaataaacgaaaataacagagctcccactaataaaaggactaacgatcgttttaccttgttcatactctccctcctttcatttatattttatttaaaataaataactgcattgataaaaacttgatcaactaatatttaattttcgataatactataccagtataaaatataatattaattaatcatatctataataacattttatactaactaaataactttttttctcaaacatataataattacactttaaaacaaaggattttgtaaaaatattactactaatcttcttaatattaattttatagaaaatttacattagatatgataaactatctatgcatataattatagaggggggatttatatcatgtataaaattgttctatacagtgacgaacgtaatctacttgaacctattgttgaagtttttaaagaatatttacctagattatcagaatctcattttaaaatccttaaattctattcatcattagaattgaatgaatttaatgaacaagaaaatatcgctgatatttattttttaaatatatcaaataaaaatattgaaaacagtttatctataggtaaaagaattcgtcaacttaatccgtatgcatttataatttacattactaatattaatacatatcaagatgattatttaaaaatactaccatttgcaattttaccaaaaccggtttcaaaaaaacagctttttgcgctactttcaactatttttaaattattaaaaaatgctgagcttagcttattagaaattaaaaccaaaaaaggtaccgttactattgaccgtcgcctaataacatttgtagaatatgaaaatcatcatctatttattcataccaaaaatggttctatcattaaaagtactacaattaggacttcttttaaaaaatggatggaaccattattaaaatacgaatcctttatctcaccacataaatcatatttaattaatatggattatgttcaaaaaatcatgaacgatcatacctttgtaatgcaaagacaagaaattattcctatttctaatcaatcttttaaacaaattaaagcaaaatatcttaaatacataaaaaataattatgctatcaacaatatcaaaaaaattactgatcattcatattaaataaatgttaaaatttattttatctagaaaatattttaaattagcatttattttatatgtttttattaatacattagctttaggatatttaggaattgaaaataatattttagctgtaatgatcattatttgggcattaataatttttatcaatgatttaacacataatgaaataagtataaataagaataaaatacttatttatacttatggcatgattttgtttttagcaactatttgtaaccaaaaatacagtgattttaagtcttacttaattgctatcatgcaattaatagtttttactttaatttttagtaacaaaaaaaatatgactaaaactactatcaaagaagaaatacaaacaattattccctttactaatgtcttagttggaattgccagtggaatttctttgatcatgtatttatttaatttttatgatactaaaaacggttggatgatcggtgtctctggggagcgtttatttggggtttattttaattgtaatcctgctgcttttttagcctgtattacgattttattggctatttatgcaattacaaataattataaatataaaagaatttattattttaatatcatcattcaatttatctatattattcttactaaatgtcgtagtgctttaatcattttagcagttatattaactgcgttgatatattatttttttattaaaaagaaaaattatcgaaaaatcaaaaaaatcttcgttttatgcagtacttgtattttaattgtttttagcagtttattgattgataaaggaatttcaacgatttttaataattcaagtgaattacaagaagaaagtcgttttcaattagaaaaaatatatgaggctacgatttctctattaaaaggtgatacgtctaaaacaatcgaactacttgatcaagttagtagcggccgattagaattactgaatacttcatttgaagtttggcaaattagtcctattataggtattggtgctaataattttagaaaaatgggaatggcagaaactgatggtactacgattcaaggaattcaagtcgttcatagccataatgaatttattgaatctttagttacaactggtattattggattttctttgtttgtcgttttctttatttcttgttttaaaaaacttagtaatttattaaaagcttatcatgataaaaaagagtattttaatttattattgttttgtttaattatcattagcgaagttattggtggaatgtttgattatggtgttttttatgtctattctctttctactgttattgcttggaactttttaagctattgctgcttaaatgagcaactaaataaataaccaaaatgcatcagcactttggttatttttattttaaatattttattaatatttaattaaattaatgaacttattactcattgaaaggatcttcaacttcagtttcctctatttcctgaacatcattatcagaattatcattctgattagcttgacatccagttactgtaaaagcaataagaaatattatcaataaaaggatctttttcttattcatcttttttcctttcttttatccaaacggatcctcgaagtcaccttcatcaataccaggaacattactagtagtaataatatcattacttgtaaactttacaatatccacttcaggtgtttcataaatatctttcattttttcctccttaataagctggtaagataccgcttttagatacattagcactataaatcgtcttttcactaccatttttatctttataaattacatacattcttccactacgagctgctcctgctttaacgttatttacattaataacaaattgactttcgttatttttactgctacctaacatttttgcagttgccattgctgtcgttccaatataaaaattatctattactggatcttcttcaggggtaaacaacattccatattcaattaatgtatacccttctggtaagaaaaattttccattaaagcttaaacggtatttaccattaactggctgaatcgtacatataggatccatagaaatcgttgcctcttgttcgatttctgtttcatttggaacatatactgctgttaacgtaatattaccaactactataaatgaatagttttgtttatatgaaattatatcgccgctttcattaacccaatgtgaaaactgcatattagctattgttttagctgttaccgtagctactgctcgattaatatattcttttgtttctgattcatcattttgatcattttttgtaattactgtatattgttcttcatctttttcaaaagtaacagttaatttaattggtgctgtcatattgaaaataaagtttccatcaacagtaatctcttcatcagtttctaaattaacagccttgattccagtaaatttatagcccgaattagctgattgtgtgattttaactgttttccctttttcaatctcatttaaatctgtaacaacttcatcatcaacaataacttttacagttccattatttgcttcaacagttaaaggatataaaattggctgtccaaaaattgttccatcacaaataacttgaaaattctcgccatatttttcactagcaactatttttttatgatcagtaccaactgtaattaaatcacccgttgcaccagcagttacaattttaaattgatgcaattcaacaccttcatcatgactaacagttattttaccaattggtaatttatgataatcatcttcgatctcaactaaatttttagttcctgcaacaataattttcataatgccagtactttcatcaaatacagcacttttaacttttgtattatttaaagcttgatcaaattctaaatccattttacagtcattaagatgctgtccatcttcatctgttaactgtagacttatttgatatgaagaaatattttcagaatttattttacttaattctaaccaaacattaactctatcattgacatattttccatctgcttcagttcgtaaaatatatggtgcttcattagtttcattttcttctaatgccgcagtcggtatgactaccgaaaataccattacagcagaaagaagtaatctcatccatatcgattttttcatgtattcctcctgttttatatgccactgtaaagcattttattttacagttagcatggtattttatttaatcctcatcattttcttttatgatggcttctggcaatgctgctttaaccattcgactggtattcgtaagtgttattctaggcaaaatacttggtacatctacaacaaaactatcgctgactagacgctctcccgctaatgttaaagcattatcaactcgatataactgagcatataactttgttggaagttcaacaattatatcactaccatcactattagctccaggtaaaccatatttaccttcattttcaccatttaatggctctaaccagtaaatccaagttccatttcgtgtatttgcaatcgtctccccagcagctggtctttcagcaaagaatacctgataaccactaattatactattaaggttattagctgtactatcatcatgcataatgtaattttcattatatagtttaactacattatatgctgcatgtcctgtatactgtcctgtaacaataaatgaacctgccggaatcttattatcagcatctaattgataatcttgatctaaaataccaattgtattttcaacatcccagacttcttttccagtttgttcgtcaatatgtgaaataccaatatcaacattatctccagactgtgctaataacttgatttctgtaatactgcagtttggatcttgaagagctaatctaatattagttacatttttcaaaccatagatattattattgttgttagcttttttgaaatacgcatatgcatatccatctggtccaacctctttagcataagggaaatcaaatgctccaagctgcgtatagctagcaccaccattggtactgtattgaagaccaaaagcccaaattctggtgttaccagttctatatttgaatcctacaatatcctgtggtgaatttaaattaattgttaaccaggctttgctattatcagttgttttaccattaaatgtcgtatctaaactatcatcaagaactaaattagcagcactttctgtttttaatacttctccagtatccttatcaagatattttacatccataatagttgtatatgtaacctctgcgttagtcgttacatcggtatattttttaccgtcttctacttttgtaccatcataaacagttaatactcctgctgtagaagttgcattagtgcttactgtccaattatctgttggtagttcaccatcatgtcggatcttgattggctctaattctttaacggtagtggcatttaaatacttatcataagcaatgacctgataagtcatcacacgattatttaatgaacttacaatatcagtatattcagttatctcattttctttatctggttctacaaaagcaactgctttaccatttctaataatctcatatcctaaaacagcatttttattttgttcattaggtaagcttaattttaaagtcacttctcttgctttagtacctgtaccttgaattaattcaacatctacatcagtagaagtcattggtgccccatttgcaagagtgtattcgtgagctgcatcatttaaatattgaattttgcgttcttcttttggaaattgatttgcataattttgggtagttgcatcaactgtatatccccatgctttaaagaaatcagttaaatctttaccagcagctgcaatcgctgtccgcataatattttgatcaacagtaccttcagaaattgctattccaccaggtttaggagctaatgaccagtctcttctcataatataataacgtgcaaagaactcattattccacattatagcataattttcttgattataacctgtctgataataatcgtaatgtgaataattttgatcataagctaaatgaagctgccaatacatacctagttgtgcaaatacgtttgcaggtttccctgttgttcctgatgtaacatgctgataaacttcagaatatgggattcgtgatgtatctgctgtatctctagttttttcaaactgtgaccagatgttatttgtaacttcagcaatcgtcattttagtaacatcagcattatgtcccatttcatgagcaataccccaaccaaacatatttcctgatattggtttaccattttcatcgacttcaacacctttacctgaagcaactaacggtacttgtgcatattcaattcctaaatgatttccaccagcatacataaatgctcctgcaaacattctttgatatctaatattaaagcgtgctgttggtgttccatgtctaccatttgctgcagctggacttaaccctctttgcttatagaaaagttctaccatttgattcattgccacagcattatcatgagctgctttttcaagatcagatgcattactatttttaagtccttgtaaaaattgatcagctgaaactgaaattaaaacattatccaaacttatttctgtagcatttaaatagcagttttttgcatcataagctttttcagtcttatcgaaatgatcattatgactgttctctaatttttcaacataatcttgtaattcttgtacatatgcagcaatttttgcttcccagccctcttcgcttcttcgagaatcgccaattgttcgatgaagatcaagtaccggaatcttgactgcaccacttattcgaactttaataggattgttttttatatcattactattagtgtgaacaagatataaagaaccacctttttcaaaatcaagattagatacttctggaacagttacctcattcaagccctgtttcaatgcgatttctccagatttccatgctgaagattctgcgtgatattgagtaaagactaaacgtactggtacgtcatcacctatatttttacccttttgtccaacgtaaatattgatcttatcacctgaaccagcaacatatcctaatggttggaaaccactaagaccaccattaaagcctaaattaccagtgccttctagagttacatcagatttgacatcgactgtaccgccaacatcaccatcattcaatatctttcttgcattagcaagctcacttaataataatgcttttttagggtgttgttcaccactgatttcatctataatatctgttcttgcttcaagttcttgaatttctttttcggtaacatcatctcgcaacgttacatgcatctcatctgtatataatccatatacatcatcttctaaactatcgtattcaaagaaattaatttcagaaatagtcataactgcagccatatatctttgaatagcaatttcaattctgttagttttaattggctgattaaaagtaaatcttaccgttcctccacttgcagtagtgatacgtgttggttttatttggcgagtaacttctactctattaccattttcatcccaaataaatacatgatattcagaatcaggataaacattatatccagcttcaagacgtgacgtcataataaattctttaatgttgtaaaaatcatcaaacgtaacttttggaccaacccaccagttagtctgtttagaatgccagaatgttgtataatcaccatctacaatatcagaccaaacaaaatttggacattcattagaattgaacccttgataatacatcgatcctgtaatttcttttatatgagtagatcctagtggtgcactctcgcttttttctgtaggccagtttaacattttatattttgaaaattctggtactgtaacgatcgtcttaccaatagctggtaatgaatgtggtccacttctaggatttccattatcgtcgctattccatccataaacataaatttcatattcagtattatcagctaatcctgtaattgaatagctgttactatagatgttatgaatttctgtatattcactgttagttcctttttggcgatagcctaaagaataatattcagtatcttccattgctttccatgaaacatctaattggcgatatttaccatttaccttgacgttatcaggaccagcaggagcttcagcagctaattgcttatgctcaacttctgacgaatatggacttgaccagttaccatttactgatttaactttgatataataagtccataatgaagtaactttatctttagttccaccagtaaatctttcaatcttgatttgattcacacctgctgaatatgtattagcagcaactgtagttccatctggttttttagcatacatagacacttcataaccagtaacatttggttgagcattccatgttacagtaatttcgctaccctttccctttacttgaatattatcgggaatatttaattctggttctggattcgagattccatatcatttaaaaattcaacttttgcaatttctgtcaagttagtatttgtagcagtagcagttactacaattgtcacttttttaattgcaatttgctcttttaaatcaataacaatacttccatccgcttttctaactgcagtagccgtagttgcagatcttcttgatgtattttcatcaatgattggaatcataaccatttctgtttcttcagattctccatctccagcggctttaatgatcttttctacttcaatcgtccccgcagttggtccactttcaacaggagcagtaataacaattcctccggtttgcatttgtgaactacttaaatccatttcaatcttaactggattttcttctgaaatattttcagcatttttaggtgccaaactaattagctcttgaacatcttccataattgtgtccagtttacgatcacctgtaggaattgcagcttcttggactgatgcaacttttactgctgatggtaaaagtgtttcaattggcgttgcttcttttacttcctgatccatattacatacaagaatagctagatctgcaacatcgataacaccatcttgattaagatcataaattgcttcaaaagaatgttcctgttcaccaccttgatcaattggtccgtctatatctggtaaatctggaccatttttatcatcactgatagtttcactttcatcttcatcttgattattaatttccacattatcaatttttttatgaccattatgttcaattaaaattttactatcttcttcatttatcaatccatcagcattaatatcaccaagtgcatatattccaatattatcagaatatatcgtattatagctgtcactaaaaactaacgtcgttttcgtatcttctttgatcgttactttttgtgaaaaatcctggaaaaaataactagtttctaatgttagctgatattcacctggctctacattttcagctttaaaaacaattaaatcttcattataactgctaatataagcatgaacatgtctagttgaatattctggatgacttgttgtctgtgctgctgtttcatctgtgtttacatctgtcccttgtaaacaaactttaaacatatcttttagttcttctaattgttctaatgatattttaaaatctaatcttaattgcagttcaaaattcacgtttgtaacatcaccgatttcattatctacaacatcatcttcatcattagaaatttcatcattccctgtattatctattgttcttacattagaaacaggtaccattgtttcatcattgttagtttcatcatatgcatatacagcagccatttgaaatgtcatgcataatgctaacaataacgcaaatattttccttttcaattaatcatactcctttccctatttttatatagatatcctaatttttacaaaaaaaatgttttttctctgctactaaaaacatatcgacaagcatacctatataccttcattatctcttaatatttaaaagatttagtaaaattttatatgattaaaaaatgagtaaatctatttaccataataaattgatttactcataataaattttactatcttttacctttataattaagtcacagcaggcaatagcagcactccgatgagaaatgcacaataccgttttttgttggaaattctttaaattatctaataatttcttttcagtatcaccatctaaagaagcagtacattcatcaagtaacaacactggcgcttcactaataattgctctagctacagcaatgcgctgtctttgtccttctgaaagaccaatacctctttcttttaataccgtatttatcccttctggcaattcatcgattacttcttttaaacaggctatttctatagcctgttcaatttgcttatcagaagcattttgattaccaaataaaatattttctttgatcgttcctgataaaatcatattaccctggggaacataagaaaacatatttcttgttccagcatcaatcataatttgatcatcatgtgtttgaataaacagcttcccactatttaatttaattagacccaatagcagatgaaataatgttgtttttccattaccagattcccctgtaatagcaataacatttccttttggaatgaaaatagaaacatcctttaatacttctttatcatcataagaaaaattaccattttctaaaacaattccttcaaactgttcataaaaactttttatattttcaattttatgatccttactttcatcttccaaattctcaatttccattaaacgcgcagctgaagcaatcatactatcgtaacgaggaatcaatcctgaaacattacgaaatggtgctttgatttggtcaatgatctgtaaaaaagctgtcaacgtcccaaaagttaaaaggccttgagaaatttgaatcgcgccccagccaagtgctacataataaccagttgtcatcattacgtaaatactagtactagcaagattgcttattgcattttgcttgacccttagctgataattataattttgtttttcttctaactgctcttttattgaatcttcatttacaaacgatttaattacgattacattttcaatacattcttgcataaatgaacgcgctattccctgcgatttctgtacctctttatgaagaaaacggaatcttttactataaagacggctgcatataacagtaatcattccaattattaaaataattaacgtaaatttagcatctatcgtaaacaatacccaaatccccgcaataattttagtaaacaaagaaaacatctgtggaataaaaccaacaattccaccggctacgatttcaatgtcacttgtaaaacgattcattaattctccggaatgcaaagttatgatttcttgatattctttatgtaatagtgtcgttaaaagatattctttcatgctgttttcaatttttgcctgtgagcgtacccgacaattatttgaaataatattagctacagcttgaaaagcaatgattccaaacaaaaatacacaagtatttaaaattgaacctgtagtacttttggttgcgatatctaatatttttttggatactacggcaatcaaaataaaacttccggaaattgccatactaattattgttaacagtcctaccatccataaatatcttttactacatttatatatccattttattgttccattttttttcatcatttctgtcctttaactcatcaatcttctagacagatgacttctgtcaactattattcatcaatcaaattatcttttcttaatttttcaataaataaagtaatatcttctttagccttttctaagcttatttcgtatttttccaacattaaagacaatatctcatcttcatttttaccagcttctaattgttgccaaataaaagcacctgtttgattaagctgaatcatcccttgaaactcattttgattattgaccggaacgactacataattatcagctaattttctaattataaatccaggttttatcttcattatttcatcacctttcttagttctttttatttgataaagtctcatcattatcaaatcccactttttttaaaactttatctgtttctttcatgccttttttattaaagggcattttgattattttcacaaattcactatgttcaaaaataaacttaattacaccacggtgaatccaggcaaatggtagtaaaaacggaaacttatttaaatatgtatatttagacttcatattctttaaactaggaaaaactagcccatgtaacattttgactctgttttttatgatcctgtttgttttatttccatctttcaacatctgattattcaaactattttgaacagtaccataagcaccactattaataatacaattgattaaatcatcattttcgaattgataatcatcatcaaaacaattggttattaaaatctttatttctttttcaaatttcaataaacctgctttttctaaatttgtctcaatataatttcgattacagcgagcctctaatttatcttcaaaaattataaaatccagcagcatcctaattccaattccgccatgtataaaatgttttgctagatgtccgaccataaaaagataataatcatcaatattcatctcataagcatattcactattagctgttttagtacaacgttgccagactgtatcaaataatgcatttaaaacatcattatcactgtaacagctacgatgcatttcaacagttagatgaggtcttttgaaataaatatcatgatgacctccaagggcatatatttgataatcaatttccaatagtgcctgttttactaattctgtcttttcttctttaaataaaatatctaaatctgttaaaaagcgcatgtctggtgaaggataatagttcttaagaatactaccttttaaaggcacattttcaattccgcattcctcaaactttttttgaatctgctgcagttcaaaatgctgattagcctctctaactatgcctttttgcattgccagtttaaatttttgatagatgtctttaggcatatttgtctgctcatttgataaataaccaataatattattaatgcgatgatacttacataatttatatatgtaattccaatctaatccttcttctactgttaatgtataattattgtttaatactgcttttaacattttaaaaatatatttgtgttctcttgtcttatccactataacctccaatttacacgaaataaaagctatcaaaatgactaacttttaagatttactgtttttatcttaaattggtaaactagatttaattttctgatatttttatgctgacaaacattataaaaatacctgataaatttttatatttaatagacaataactagtgtgttgtaatatttattctaaatattacaacagcttataagctgttgcgttttaaattatttaatttatccataaattcttatcaattttctagttagaaaccactattattctatctaatctaatgataaattacaataatttatcaatcaattatttcatttaaaatccaataaaattaatactacttatatttttcaaccattactggattttaatcatcttatatcctaatcatgtcttaattcattaactattttaaacagatatatcatcattttcctaagccataaaaaacagcaccaaaatcttacatataatttatatctatatgatgatatctcaatatatttattatcacgataaaaaccatccattacccctaatatttgctgttcagtaattccaaactcttttttccattggttatcaccacacatgacatattctttatcttttatttttaaaactcgatgtaaaatatactttccattatctcttttatataaaacaacatcatattttttaggaatccttcttttgataactacagtatctcgatcaggtcttattaatggcagcatactacttccagatggcattgtaactaaatatcctttttttaataagatatcttctaatttttcattcatcattcaaataatcccttttccatttttactaactgcaaataatattaaataaatgttttaatttcgcgcttatcatctttcatcttattataagccattaatgctgcctctttggaaatattacatttcatccgataaattggtactttttttaaaacctcctctaacattataaataattcttcgagcataatctgatttcttggcaaaattgtttgttgtagaatcagtggtattacttttttagtcgtgatcaaatcaattctgttttctattcctctttcaagcatacaaattgcctgtaaaggcactcttaaattcaaattttcatcagttttaccactaaaaggtgtcccataagcaaagcacttcccctcttcaatcctaattgccggtttatcatcattaataataatcgctttatcaccaaaacattcctgccataatttagtatgtgttgatttaccagtaccacttggagctgaaaataaataagctttattatcaaccactatagctgaggcatgcagcatgaatccccctaaattaattaatttgcgataaaactctgaccctgcaaaaatatattcgcattgttctaacgtcaaatgaggattttcttgttgtttaacacgacaaaacgcttcatttatcgaaagttgtatatctgatttttgttcatctacgcgatattcttccatttgcttttttaataaaaaataaattggttcatattcaactatacaaccagctattttataaaatcccatctttattaaatcctcttttcattattttttactattttgaaaacaaacaccttaaaatatacagaataagagctaatagaattagctcttatacacttatatatattgattattttacaacaaactctttttcaagagtatatattgttccatccatacaaatatctaccattactttataagtagctccttgggtaaatttatatccagcctctataaaatatacagtaccatctgaattatatgaacttcttagcatcattttattggttaaacttcctcctgaaactactgcaaatttaacttcatcataacttgttgatggtcgataatctaaaatatctaccgaattagtaaacttgatatcaatttctgtaggaagcatagaatcgccagttaaataagcttcaacagattcaatatctatcggtaatacaggattaggatctactggtggaatataatcaggaattttggctactgtatgcgaagcatatcctgcctgatagtttccagcttcatcaacatataccataaatacatttttgtcagttccattatatggaatctcgatttcgttatatccagcatacattactttacttgttgaagcaactgcaccacttataacgtcagctgcttttggtgtattattttcattactaacagcaccgttccatgaatatgtaccaatatacaatgttcccgcttcatcagaattaaaactaaacttaattttgtcttcagcagtacgttctactgtttctgatgttattcttgggggattaaaatgtactacaaagttctttttagccacagtaccatcactaaaagttattttagctgtgtattgattatcaagatgaccatagttttctggaataacgatcgtataagttaaacgatctggacttgttattaaggttgctttatcaattgtaattgctgaattagcaggacagataaatgagaagttttgtaatgtcaatacttcttctggagccttattcaatttaattgtaattgtattcattggcttttcttcaacaaattcaatttgatattctctagaaatatttggatcttcttgaatcgaaccactaatatctaaaggtccatgaacatcagattctctaccatcatatgattctaaaacataatacattttataactggtacccttatttaatccattaattaatactttattaaaacctgttttaatttcttgtttatatccctttttaactaaatcaacactaatatcacttgatcttgaagtttccattatttgcgtatgtccaggaatataaatatatacatatccaccttcatcaacatcaaataaatcgaattctgctctagtttcttcacttcttaaaacagttgcattggttactgtaggacaatttactttataagaaaattctttttgaataattcttccatcatctaattcgatagaaaatgtatatgtgtcatctctagcaaaagtcgatgttgaaatatcatatgtcttattatccgcagttgttacatctaaaatcgtcattattgttccaccatggcataaaattgccatatcttcttttgtcaacgattcattagtagcgttagataaagtaacgatcattcgattcatcccttttacttctacagcttcaatactataattaattactaatccaatattgttgtttccattgtcttcaactttatcaacatttccactaccagtaatatttgtacctgttccattaacaataatatttccaacgttattatttaattcaatatttgaaccactagcactattagaaatactaacattacctactgtattattgattactgtattttcgactttggtattgatatttatattattaacatgagccacaccagatacaatagcacttccattaagaattacattatctacatttttatttaatgttaaaatacttccattagcacttgcatttactgttatattcccaactgcaagattaatacttaaatctgcaagattagatactaataaattatcaatagttaaatcaccattaacagtcatattactagcagccactaaatttggtagattacttccttcttttaaatttaaaactaccttacctgaagaacgcacacttctagcttccataactgtatcaatgctatcgaaaagagttttttctgcattgatctcaacgttagcttcacttgaaacctctaggtttct

(The sequence listing continues in the following parts.)

What is claimed is:

1. A method comprising:

(1) quantifying an abundance of a member in a pharmaceutical composition comprising a mixed population of at least two members, the method comprising estimating unadjusted most probable number (MPN) abundances of the member and at least one other member in the mixed population using an MPN assay, and estimating an adjusted MPN abundance of the member by transforming the unadjusted MPN abundance of the member with a predetermined calibration matrix; and (2)(a) administering the pharmaceutical composition to a subject in need thereof at a dose of the member that is an adjusted MPN abundance of the member within a defined abundance tolerance, or (2)(b) packaging or releasing the pharmaceutical composition for administration to a subject in need thereof at a dose of the member that is an adjusted MPN abundance of the member within a defined abundance tolerance, wherein the MPN assay comprises:

(i) preparing a plurality of serially diluted samples of the mixed population;

(ii) incubating the plurality of serially diluted samples of the mixed population under conditions to allow replication, metabolism, or gene expression of the at least two members;

(iii) identifying presence or absence of the at least two members of the mixed population in the plurality of serially diluted samples of the mixed population; and (iv) determining the unadjusted MPN abundances of the at least two members, wherein the predetermined calibration matrix correlates unadjusted MPN abundances to reference standard abundances of the at least two members in a calibration sample, and wherein the calibration sample comprises the at least two members in predetermined reference standard abundances, wherein the calibration sample is a composition comprising a mixed population that comprises at least two population members at defined reference standard abundances, wherein reference standard abundance of a population member i is an abundance that has been measured in a manner free from influence of other population members j, wherein abundance is the size of a population in terms of discrete individual units, wherein the calibration matrix is a matrix comprising elements that correlate (Y) reference standard abundance values of at least two population members i and j in a calibration sample, with (X) unadjusted MPN abundances of the at least two population members i and j in the calibration sample, wherein unadjusted MPN abundance is the most probable number of individuals of a population member i in a mixed population under an assumption that detection of a signal of the population member i in a replicate of an MPN assay is independent of the presence or absence of any other population members j in the replicate, wherein adjusted MPN abundance is the most probable number of individuals of a population member i in a mixed population after accounting for the effect(s) of one or more other population members j on the population member i during the MPN assay that may affect detection of a signal of the population member i in a given replicate.

2. The method of claim 1, wherein the predetermined calibration matrix comprises one or more elements accounting for interactions between the at least two members of the mixed population in the incubating of (ii).

3. The method of claim 2, wherein at least one of the elements of the predetermined calibration matrix is derived from a regression model correlating a predetermined reference standard abundance of the member to unadjusted MPN abundances of the at least two members in the calibration sample.

4. The method of claim 3, wherein unadjusted MPN abundance of each of the at least two members is calculated with assumption that identifying the presence or absence of a member in step (iii) is independent of the presence or absence of other members in the same serially diluted sample.

5. The method of claim 4, wherein predetermined reference standard abundances of the at least two members are defined by abundances of the at least two members in separate samples each consisting essentially of a single member, and wherein the calibration sample comprises a combination of the separate samples in a predetermined proportion.

6. The method of claim 5, wherein for the set of the at least two members of the calibration sample, mean deviation of adjusted MPN abundance from the predetermined reference standard abundance in the calibration sample is less than mean deviation of unadjusted MPN abundance from the predetermined reference standard abundance in the calibration sample.

7. The method of claim 1, wherein presence of a member is defined by detection of a signal of the member above a detectable threshold, and absence is defined by lack of detection of the signal above the detectable threshold.

8. The method of claim 1, wherein the method further comprises the step of: (1)(b) identifying the pharmaceutical composition as comprising each of the at least two members at adjusted MPN abundances within the defined abundance tolerance, and wherein:

the administering of (2)(a) comprises administering the pharmaceutical composition at a dose of each of the at least two members at adjusted MPN abundances within the defined abundance tolerance, or the packaging or releasing of (2)(b) comprises packaging or releasing the pharmaceutical composition for administration at a dose of each of the at least two members at adjusted MPN abundances within the defined abundance tolerance.

9. The method of claim 1, wherein the method comprises the administering of (2)(a).

10. The method of claim 1, wherein the method comprises the packaging or releasing of (2)(b).

11. A plurality of pharmaceutical compositions made by the method of claim 10.

12. The method of claim 1, wherein the mixed population is a bacterial population, and each of the at least two members is a distinct bacterial strain.

13. The method of claim 12, wherein one or more of the bacterial strains are strict anaerobes, and wherein reagents used in measuring reference standard abundance and MPN abundance are pre-reduced in an anaerobic environment for a duration sufficient to eliminate negative influence of environmental components on bacterial growth, wherein the reagents comprise diluent and culture media.

14. A pharmaceutical composition comprising a mixed population comprising at least two members at adjusted most probable number (MPN) abundances within a defined abundance tolerance, wherein adjusted MPN abundance of a member is estimated by (1) estimating unadjusted MPN abundance of the member and at least one other member in the mixed population using an MPN assay, and (2) transforming the unadjusted MPN abundance of the member with a predetermined calibration matrix, wherein the MPN assay comprises:

(i) preparing a plurality of serially diluted samples of the mixed population;

(ii) incubating the plurality of serially diluted samples of the mixed population under conditions to allow replication, metabolism, or gene expression of the at least two members;

(iii) identifying presence or absence of the at least two members of the mixed population in the plurality of serially diluted samples of the mixed population; and (iv) determining the unadjusted MPN abundances of the at least two members, wherein the predetermined calibration matrix correlates unadjusted MPN abundances to reference standard abundances of the at least two members in a calibration sample, and wherein the calibration sample comprises the at least two members in predetermined reference standard abundances, wherein the pharmaceutical composition is packaged for administration to a subject in need thereof at a dose of each of the at least two population members within the defined abundance tolerance, wherein the calibration sample is a composition comprising a mixed population that comprises at least two population members at defined reference standard abundances, wherein reference standard abundance of a population member i is an abundance that has been measured in a manner free from influence of other population members j, wherein abundance is the size of a population in terms of discrete individual units, wherein the calibration matrix is a matrix comprising elements that correlate (Y) reference standard abundance values of at least two population members i and j in a calibration sample, with (X) unadjusted MPN abundances of the at least two population members i and j in the calibration sample, wherein unadjusted MPN abundance is the most probable number of individuals of a population member i in a mixed population under an assumption that detection of a signal of the population member i in a replicate of an MPN assay is independent of the presence or absence of any other population members j in the replicate, wherein adjusted MPN abundance is the most probable number of individuals of a population member i in a mixed population after accounting for the effect(s) of one or more other population members j on the population member i during the MPN assay that may affect detection of a signal of the population member i in a given replicate.

15. The pharmaceutical composition of claim 14, wherein the predetermined calibration matrix comprises one or more elements accounting for interactions between the at least two members of the mixed population in the incubating of (ii).

16. The pharmaceutical composition of claim 15, wherein at least one of the elements of the predetermined calibration matrix is derived from a regression model correlating a predetermined reference standard abundance of a member to unadjusted MPN abundances of the at least two members in the calibration sample.

17. The pharmaceutical composition of claim 16, wherein unadjusted MPN abundance of each of the at least two members is calculated with assumption that identifying the presence or absence of a member in step (iii) is independent of the presence or absence of other members in the same serially diluted sample.

18. The pharmaceutical composition of claim 17, wherein predetermined reference standard abundances of the at least two members are defined by abundances of the at least two members in separate samples each consisting essentially of a single member, and wherein the calibration sample comprises a combination of the separate samples in a predetermined proportion.

19. The pharmaceutical composition of claim 18, wherein for the set of the at least two members of the calibration sample, mean deviation of adjusted MPN abundance from the predetermined reference standard abundance in the calibration sample is less than mean deviation of unadjusted MPN abundance from the predetermined reference standard abundance in the calibration sample.

20. The pharmaceutical composition of claim 14, wherein presence of a member is defined by detection of a signal of the member above a detectable threshold, and absence is defined by lack of detection of the signal above the detectable threshold.

21. A plurality of the pharmaceutical composition of claim 14.

22. The pharmaceutical composition of claim 14, wherein the mixed population is a bacterial population, and each of the at least two members is a distinct bacterial strain.

23. The pharmaceutical composition of claim 22, wherein one or more of the bacterial strains are strict anaerobes, and wherein reagents used in measuring reference standard abundance and MPN abundance are pre-reduced in an anaerobic environment for a duration sufficient to eliminate negative influence of environmental components on bacterial growth, wherein the reagents comprise diluent and culture media.

24. A method comprising administering the pharmaceutical composition of claim 14 to a subject in need thereof at a dose of each of the at least two population members within the defined abundance tolerance.

25. A method comprising administering to a subject in need thereof, or packaging or releasing for administration to a subject in need thereof, a pharmaceutical composition comprising a mixed population that comprises at least two members at adjusted most probable number (MPN) abundances within a defined abundance tolerance, at a dose of each of the at least two population members within the defined abundance tolerance, wherein adjusted MPN abundance of a member is estimated by (1) estimating unadjusted MPN abundance of the member and at least one other member in the mixed population using an MPN assay, and (2) transforming the unadjusted MPN abundance of the member with a predetermined calibration matrix, wherein the MPN assay comprises:

(i) preparing a plurality of serially diluted samples of the mixed population;

(ii) incubating the plurality of serially diluted samples of the mixed population under conditions to allow replication, metabolism, or gene expression of the at least two members;

(iii) identifying presence or absence of the at least two members of the mixed population in the plurality of serially diluted samples of the mixed population; and (iv) determining the unadjusted MPN abundances of the at least two members, wherein the predetermined calibration matrix correlates unadjusted MPN abundances to reference standard abundances of the at least two members in a calibration sample, and wherein the calibration sample comprises the at least two members in predetermined reference standard abundances, wherein the calibration sample is a composition comprising a mixed population that comprises at least two population members at defined reference standard abundances, wherein reference standard abundance of a population member i is an abundance that has been measured in a manner free from influence of other population members j, wherein abundance is the size of a population in terms of discrete individual units, wherein the calibration matrix is a matrix comprising elements that correlate (Y) reference standard abundance values of at least two population members i and j in a calibration sample, with (X) unadjusted MPN abundances of the at least two population members i and j in the calibration sample, wherein unadjusted MPN abundance is the most probable number of individuals of a population member i in a mixed population under an assumption that detection of a signal of the population member i in a replicate of an MPN assay is independent of the presence or absence of any other population members j in the replicate, wherein adjusted MPN abundance is the most probable number of individuals of a population member i in a mixed population after accounting for the effect(s) of one or more other population members j on the population member i during the MPN assay that may affect detection of a signal of the population member i in a given replicate.

* * * * *